United States Patent 7,582,449 (NUCLEIC ACID AND AMINO ACID SEQUENCES RELATING TO STREPTOCOCCUS PNEUMONIAE FOR DIAGNOSTICS AND THERAPEUTICS) - sequence listing, part 2

SEQ ID NO: 4694 - protein, 407 aa, Streptococcus pneumoniae
MITKQSAFLQNRATILEFLYRNPATSRTDIVNETGLTPATTTNIIKELSEQSLIYETGDEFSEFSGSGRRRKTISITDNIPYVVGGIEINVLGIFLSLCDLQGKTLFETEILNEDYPISEINSTITNMIKTAIEYVPLETKLLGFGLSIPGHYYKDSGSIITNNPIWESFNLLNVIKRFNFPFIVKNNIDCMAIGQYLFNPHNTPDNFIFLHAGLGIYTSFFTKEKIGASKNPYIGEIGHTIVELNGQYCECGKKGCLQTYISDAWLIKHAQLLFKNSQLTVLKSLVKTEKDIHLDTLLTAYNLGDSALRQQIDKGVNLLATSIANLLLINPADKIYINSQLLNYQPFTHEVRDKIQDQLHFVPFTRNIEIEILPYNKHRGSIGACALAIVAFFIEHSNVLQDIISP

SEQ ID NO: 4695 - protein, 72 aa, Streptococcus pneumoniae
KETSNAHETTNTGIKTMTKQIPKFTKDTAQLYTCKWLLYNKVTKMYDHTVVNHSVREYITDSISTNTSKESG

SEQ ID NO: 4696 - protein, 57 aa, Streptococcus pneumoniae
LLIINRFFSLFVLDWYRTELWINTLVSYPVPKYVGRKMKQLLRVSVLEKILSIEFFK

SEQ ID NO: 4697 - protein, 61 aa, Streptococcus pneumoniae
IPNFLYLLILINNTSVTILPVRSLSNHTENSSKIYLVRQSSKNSTIVQTLSYRIDFLNYIL

SEQ ID NO: 4698 - protein, 94 aa, Streptococcus pneumoniae
MDWYDYMIQASKQSQFNASHWFRYLRKVIFEDYSYLTNQDVEKLLDSKELTRFQKISLKYAFQEHTPTHKYVISLNKPAKLTNVQKLMEKYKHG

SEQ ID NO: 4699 - protein, 172 aa, Streptococcus pneumoniae
MEQLHFITKLLDIKDPNIQILDIINKDTHKEIIAKLDYDAPSCPECGNQLKKYDFQKPSKIPYLETTGMPSRILLRKRRFKCYHCSKMMVAETSIVKKNHQIPRIINQKIAQKLIEKISMTDIAHQLAISTSTVIRKLNDSHFEHDFSRLPEIMSWDVETVRGVTVSIGRWR

SEQ ID NO: 4700 - protein, 255 aa, Streptococcus pneumoniae
MEMSFIAQDFEKLDIITVLEGRTQAVIRDHFLKYDRAVRCRVKIITMDMFSPYYDLARQLFPCAKIVLDRFHIVQHLSRAMSRVHVQIMNQFHRKSHEYKAIKRYWKLIQQDSCKLSDKRFYRPIFRMHLTNKEILNKLLSYSEDLKHHYQLYQLLLFHFQNKEPEKFFGLIEDNLKQVHPIFQTVFKTFLKDKEKIINALQLHYSNAKLEATNNLIKLIKRNAFGFRNFENFKKRIFIALNIKKERTKFVLSRA

SEQ ID NO: 4701 - protein, 420 aa, Streptococcus pneumoniae
MEHINHTTLLIGIKDKNITLNKAIQHDTHIEVFATLDYHPPKCKHCKGKQIKYDFQKPSKIPFIEIGGFPSLIHLKKRRFQCKSCRKVTVAETTLVQKNCQISEMVRQKIAQLLLNREALTHIASKLAISTSTSTVYRKLKQFHFQEDYTTLPEILSWDEFSYQKGKLAFIAQDFNTKKIMTILDNRRQTTIRNHFFKYSKEARKKVKVVTVDMSGSYIPLIKKLFPNAKIVLDRFHIVQHMSRALNQTRINIMKQFDDKSLEYRALKYYWKFILKDSRKLSLKPFYARTFRETLTPRECLKKIFTLVPELKDYYDLYQLLLFHLQEKNTDQFWGLIQDTLPHLNRTFKTTLSTFICYKNYITNAIELPYSNAKLEATNKLIKDIKRNAFGFRNFENFKKRIFIALNIKKERTKFVLSRA

SEQ ID NO: 4702 - protein, 85 aa, Streptococcus pneumoniae
WVEEKLSSRKDKFCPFFFDVQSDENPFFEVFKVPKTKGIALDVFDEFVSGLKFSVRIRQFNGVSDVVFIANKCAQSGFKGAVEMR

SEQ ID NO: 4703 - protein, 774 aa, Streptococcus pneumoniae
MVVKTVVEAQDIFDKAWEGFKGVDWKEKASVSRFVQANYTPYDGDESFLAGPTERSLHIKKIVEETKAHYEETRFPMDTRPTSIADIPAGFIDKENEVIFGIQNDELFKLNFMPKGGIRMAETTLKENGYEPDPAVHEIFTKYVTTVNDGIFRAYTSNIRRARHAHTVTGLPDAYSRGRIIGVYARLALYGADYLMQEKVNDWNAIKEIDEETIRLREEVNLQYQALQQVVRLGDLYGVDVRKPAMNVKEAIQWVNIAFMAVCRVINGAATSLGRVPIVLDIFAERDLARGTFTESEIQEFVDDFVMKLRTVKFARTKAYDQLYSGDPTFITTSMAGMGNDGRHRVTKMDYRFLNTLDNIGNSPEPNLTVLWTDKLPYNFRRYCMHMSHKHSSIQYEGVTTMAKDGYGEMSCISCCVSPLDPENEEQRHNIQYFGARVNVLKALLTGLNGGYDDVHKDYKVFDIEPIRDEVLEFESVKANFEKSLDWLTDTYVDALNIIHYMTDRYNYEAVQMAFLPTKQRANMGFGICGFANTVDTLSAIKYATVKPIRDEDGYIYDYETIGDYPRWGEDDPRSNELAEWLIEAYTTRLRSHKLYKDAEATVSLLTITSNVAYSKQTGNSPVHKGVYLNEDGSVNLSKLEFFSPGANPSNKAKGGWLQNLNSLSSLDFSYAADGISLTTQVSPRALGKTRDEQVDNLVTILDGYFENGGQHVNLNVMDLNDVYEKIMSGEDVIVRISGYCVNTKYLTPEQKTELTQRVFHEVLSMDDALDALS

SEQ ID NO: 4704 - protein, 91 aa, Streptococcus pneumoniae
HLFILFENLFKPRQLPSATSKQYFELTSSVLFTTSKQCFEQPAASFLVCFSISIECNCLFSFIIPFFLKKRKKDFIFFKNIIQFEIKYRLF

SEQ ID NO: 4705 - protein, 77 aa, Streptococcus pneumoniae
NSLYFISNCIIFLKKIKSFFLFFRKKGIIKENKQLHSMEIEKQTRKLAAGCSKHCFEVVNRTDEVSSKYCFEVADGS

SEQ ID NO: 4706 - protein, 356 aa, Streptococcus pneumoniae
VLGMLIFPLLNDLSRKIIHIDMDAFFAAVEIRDNPKLRGKPVIIGSDPRQTGGRGVVSTCSYEARAFGVHSAMSSKEAYERCPQAVFISGNYEKYKSVGLRIRAIFKRYTDLIEPMSIDEAYLDVTENKLGIKSAVKIARLIQKDIWKELHLTASAGVSYNKFLAKMASDYQKPHGLTVILPEQAEDFLKQMDISKFHGVGKKTVERLHQMGVFTGADLLEVPEVTLIDRFGRLGYDLYRKARGIHNSPVKSNRIRKSIGKEKTYGKILRAEEDIKKELTLLSEKVALNLHQQEKAGKIVILKIRYEDFSTLTKRKSLAQKTQDASQISQIALQLYEELSEKERGVRLLGITLTGF

SEQ ID NO: 4707 - protein, 62 aa, Streptococcus pneumoniae
LVNTVSCLVVFCYFTVLSVYLYKKNLEGVTLQGFILLENLFKPRQLYLQPQNSVLSSLRLAS

SEQ ID NO: 4708 - protein, 281 aa, Streptococcus pneumoniae
MYLIEILKSIFFGIVEGITEWLPISSTGHLILAEEFIQYQNQNEAFMSMFNVVIQLGAILAVMVIYFNKLNPFKPTKDKQEVRKTWRLWLKVLIATLPLLGVFKFDDWFDTHFHNMVSVALMLIIYGVAFIYLEKRNKARAIEPSVTELDKLPYTTAFYIGLFQVLALLPGTSRSGATIVGGLLNGTSRSVVTEFTFYLGIPVMFGASALKIFKFVKAGELLSFGQLFLLLVAMGVAFAVSMVAIRFLTSYVKKHDFTLFGKYRIVLGSVLLLYSFVRLFV

SEQ ID NO: 4709 - protein, 216 aa, Streptococcus pneumoniae
LDKIVGKHSEYTYQLLTRYPNPQKRLEAGFDKLIEIKRLTASKIQDILSVAPRSIGTTSPAREFEIIEIIKHYKRLIDKAETCVNDLMAEFNSVITTVTGIGGRLGAVILAEIRNIHAFDNPAQLQAFAGLDSSIYQSGQIDLAGRMIKRGSPHLRWALIQAAKACARFSPAFKVYLKTKLEQGKHYNVAIIHLAKKLIRTLFYILKKSCHLTNKK

SEQ ID NO: 4710 - protein, 61 aa, Streptococcus pneumoniae
MLVSQIQQVPTPYLLEVEVLAVASLEAEVAAVSEPFKESYHRLKKYDIMEDRRKTNYKKSQ

SEQ ID NO: 4711 - protein, 630 aa, Streptococcus pneumoniae
LMKKTFFLLVLGLFCLLPLSVFAIDFKINSYQGDLYIHADNTAEFRQKIVYQFEEDFKGQIVGLGRAGKMPSGFDIDPHPKVQAAKNGAELADVTSEVTEEADGYTVRVYNPGQEGDIVEVDLVWNLKNLLFLYDDIAELNWQPLTDSSESIEKFEFHVRGDKGAEKLFFHTGKLFREGTIEKSNLDYTIRLDNLPAKRGVELHAYWSRTDFASARDQGLKGNRLEEFNKIEDSIVREKDQSKQLVTWVLPSILSISLLLSVCFYFIYRRKTTPSVKYAKNHRLYEPPMELEPMVLSEAVYSTSLEEVSPLVKGAGKFTFDQLIQATLLDVIDRGNVSIISEGDAVGLRLVKEDGLSRFERDCLNLAFSGKKEATLSNLFADYKVSDSLYRRAKVSDEKRIQARGLQLKSSFEEVLNQMQEGVRKRVSFWGLPDYYRPLTGLEKTLQVGMGVLTILPLFIGFGLFLYSLDVHGYLYLPLPILGFLGLVLSVFYYWKLRLDNRDGVLNEAGAEVYYLWTSFENMLREIARLDKAELESIVVWNRLLVYATLFGYADKVSHLMKVHQIQVENPDINLYVAYGWHSMFYHSSAQMSHYASVANTASTYSVSSGSGSSGGGFSGGGGGGSIGAF

SEQ ID NO: 4712 - protein, 521 aa, Streptococcus pneumoniae
MRKIYLSIFTSLLLMLGLVNVAQADEYLRIGMEAAYAPFNWTQDDDSNGAVKIDGTNQYANGYDVQIAKKIAKDLGKEPLVVKTKWEGLVPALTSGKIDMIIAGMSPTAERKQEIAFSSSYYTTEPVLLVKKDSAYASAKSLDDFNGAKITSQQGVYLYDLIAQIPGAKKETAMGDFAQMRQALEAGVIDAYVSERPEALTAEAANSKFKMIQVEPGFKTGEEDTAIAIGLRKNDNRISQINASIETISKDDQVALMDRMIKEQPAEATTTEETSSSFFSQVAKILSENWQQLLRGAGITLLISIVGTIIGLIIGLAIGVFRTAPLSENKAIYGLQKLVGWVLNVYIEIFRGTPMIVQSMVIYYGTAQAFGINLDRTLAAIFIVSINTGAYMTEIVRGGILAVDKGQFEAATALGMTHNQTMRKIVLPQVVRNILPATGNEFVINIKDTSVLNVISVVELYFSGNTVATQTYQYFQTFTIIAVIYFVLTFTVTRILRFIERRMDMDTYTTGANQMQTEDLK

SEQ ID NO: 4713 - protein, 246 aa, Streptococcus pneumoniae
MTQAILEIKHLKKSYGQNEVLKDISLTVHKGEVISIIGSSGSGKSTFLRSINLLETPTDGQILYHGQNVLEKGYDLTQYREKLGMVFQSFNLFENLNVLENTIVAQTTVLKRERTEAEKIAKENLEKVGMGERYWQAKPKQLSGGQKQRVAIARALSMNPDAILFDEPTSALDPEMVGEVLKIMQDLAQEGLTMIVVTHEMEFARDVSHRVIFMDKGVIAEEGKPEDLFTNPKEDRTKEFLQRYLK

SEQ ID NO: 4714 - protein, 71 aa, Streptococcus pneumoniae
MAKSNFEKVESVVGWVRDKKITGYRISKETNAREMSIIALAQGRAKVKNISFETALGLIDFYEKNYEKFED

SEQ ID NO: 4715 - protein, 76 aa, Streptococcus pneumoniae
LFHMNLSNDGFVAFHYRSYGTFFLHKNRLHNIYSGFTHYKYYRAFFLLTKVVKTYTIKYYKEENRRKTWLSQTLKK

SEQ ID NO: 4716 - protein, 65 aa, Streptococcus pneumoniae
MKSDKTIIRKIHMEQLHFITKLLDIKDPNIKILDIINMDTHKEIIAKLDYEASSCPDCGSLIEEI

SEQ ID NO: 4717 - protein, 127 aa, Streptococcus pneumoniae
MIKELYEEVQGTVYKCRNEYYLHLWELSDWDQEGMLCLHELISREEGLADDIPRLRKYFKTKFRNRILDYIRKPESQKRISDKEPYEEVGEISHRIGEGGSGLEIIISFLEPFGVLEPSWLGETREL

SEQ ID NO: 4718 - protein, 183 aa, Streptococcus pneumoniae
MKGNIMDSFDKGWFVLQTYSGYENKVKENLLQRAQTYNMLDNILRVEIPTQTVQVEKNGKRKEVEENRFPGYVLVEMVMTDEAWFVVRNTPNVTGFVGSHGNRSKPTPLLEQEIRDILVSMGQTVQEFDFDVEIGQTVRIIDGAFADYTGKITEIDNNKVKMIISMFGNDTVAEVNLNQIAEL

SEQ ID NO: 4719 - protein, 58 aa, Streptococcus pneumoniae
MRFIGDIFRLLKDTTWPTRKESWRDFRSIMEYTAFFVVIIYIFDQLIVSGLIRFINIF

SEQ ID NO: 4720 - protein, 731 aa, Streptococcus pneumoniae
MKLDKLFEKFLSLFKKETSELEDSDSTILRRSRSDRKKLAQVGPIRKFWRRYHLTKIILILGLSAGLLVGIYLFAVAKSTNVNDLQNALKTRTLIFDREEKEAGALSGQKGTYVELTDISKNLQNAVIATEDRSFYKNDGINYGRFFLAIVTAGRSGGGSTITQQLAKNAYLSQDQTVERKAKEFFLALELSKKYSKEQILTMYLNNAYFGNGVWGVEDASKKYFGVSASEVSLDQAATLAGMLKGPELYNPLNSVEDSTNRRDTVLQNMVAAGYIDKNQETEAAEVDMTSQLHDKYEGKISDYRYPSYFDAVVNEAVSKYNLTEEEIVNNGYRIYTELDQNYQANMQIVYENISLFPRAEDGTFAQSGSVALEPKTGGVRGVVGQVADNDKTGFRNFNYATQSKRSPGSTIKPLVVYTPAVEAGWALNKQLDNHTMQYDSYKVDNYAGIKTSREVPMYQALAESLNLPAVATVNDLGVDKAFEAGEKFGLNMEKVDRVLGVALGSGVETNPLQMAQAYAAFANEGLMPEAHFISRIENASGQVIANHKNSQKRVIDKSVADKMTSMMLGTFTNGTGISSSPADYVMAGKTGTTEAVFNPEYTSDQWVIGYTPDVVISHWLGFPTTDENHYLAGSTSNGAAHVFRNIANTILPYTPGSTFTVENAYKQNGIAPANTKRQVQTNDNSQTDDNLSDIRGRAQSLVDEASRAISDAKIKEKAQTIWDSIVNLFR

SEQ ID NO: 4721 - protein, 291 aa, Streptococcus pneumoniae
MQFTFTLPASLPQMTVKQLLEEQLLIPRKIRHFLRIKKHILINQEEVHWNEIVNPGDVCQLTFDEEDYSQKTIPWGNPDLVQEVYQDQHLIIVNKPEGMKTHGNQPNEIALLNHVSTYVGQTCYVVHRLDMETSGLVLFAKNPFILPILNRLLEKKEISREYWALVDGNINRKELVFRDKIGRDRHDRRKRIVDAKNGQYAETYVSRLKQFSNKTSLAHCKLKTGRTHQIRVHLSHHNFPILGDPLYNSNSKTSRLMLHAFRLSFTHPLTLEKLNFTALSNTFETELKKNG

SEQ ID NO: 4722 - protein, 359 aa, Streptococcus pneumoniae
VICSDSSYSFHNKNFMIFIRRKSLMVVKVGINGFGRIGRLAFRRIQNVEGVEVTRINDLTDPVMLAHLLKYDTTQGRFDGTVEVKEGGFEVNGKFVKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLEYFAKIAK

SEQ ID NO: 4723 - protein, 91 aa, Streptococcus pneumoniae
PYDSFEAAFIAAFTSSTVTFFSRTATNSVTDPVGVGTRCADPSSLPFNSGITRPIALAAPVELGTMFAAPARARRRSPPRCGPSRIIWSPV

SEQ ID NO: 4724 - protein, 316 aa, Streptococcus pneumoniae
MGKKRWARNGSESNDASYAQVVSLYDDTSISVSNNETDKVLTGSLYTETNEQGLTIPSSLLKNWNEQTGKNLTTNDLIGKSVSASIVESAAETSKIAQFQTKIVRVINDEDDMEDSNSFMLSHQMETILKEAGFTKAVSYFILELKDPSQTKVVTEELQKNKKYTVLSQQRVLDIVITFIRVIQGLLIVLSSQAIVVAAVMIGIIIYINIMQRSKEIGVMKAVGYQNRGVKGIFIYEAIWIVGIALLLAFLVAQGVGSLANAIVSHFYPSITKVFELNLLSVLGTLVFALLLGYVSAYFPARKISKMDPVESLRYE

SEQ ID NO: 4725 - protein, 112 aa, Streptococcus pneumoniae
LVAGLTNGELIAPMTYEEMMTSDFFEAWFQKFLLPTLTTPSVIIMDNARFHRMGKLELLCEEFGHKLLSLPPYSPEYNPIEKTWAHIKKHLKKVLPSCNTFYEALLSCSCFN

SEQ ID NO: 4726 - protein, 86 aa, Streptococcus pneumoniae
MVWLMLVRETSETKLQKSRSSSSLRKSLERLTHHLLDLQPKKSSDIFFQILYLFLTDLLMSDHILDKNKYRILFHQSKQVLGALNY

SEQ ID NO: 4727 - protein, 115 aa, Streptococcus pneumoniae
MWYNLLMAYSIDFRKKVLSYCERTGSITEASHVFQISRNTIYGWLKLKEKTGELNHQVKGTKPRKVDRDRLKNYLTDNPDAYLTEIASEFGCHPTTIHYALKAMGYTRKKEPHLL

SEQ ID NO: 4728 - protein, 299 aa, Streptococcus pneumoniae
VILKIEDLVMSIISTDLTPFQIDDTLKAALREDVHSEDYSTNAIFDHHGQAKVSLFAKEAGVLAGLTVFQRVFTLFDAEVTFQNPHQFKDGDRLTSGDLVLEIIGSVRSLLTCERVALNFLQHLSGIASMTAAYVEALGDDCIKVFDTRKTTPNLRLFEKYAVRVGGGYNHRFNLSDAIMLKDNHIAAVGSVQKAIAQARAYAPFVKMVEVEVESLAAAEEAAAAGADIIMLDNMSLEQIEQAITLIAGRSRIECSGNIDMTTISRFRGLAIDYVSSGSLTHSAKSLDFSMKGLTYLDV

SEQ ID NO: 4729 - protein, 436 aa, Streptococcus pneumoniae
MIHLIMISAIALAIGIGYRTKINIGLLAIAFSYLIATTLMGLSPKELLHFWPTSLFFTIFSVSLFYNVATTNGTLDVLAQHILYRTRTHPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 4730 - protein, 61 aa, Streptococcus pneumoniae
NIVRNRFDYPDLFVLFLFHFTISQIEYDEVRSHVLGTHFLHIFHILESIDKDYWDEFLKLN

SEQ ID NO: 4731 - protein, 64 aa, Streptococcus pneumoniae
MKGKEYENRTVSFAISSKGEKMKVENISYRVDHRILFDNISFDTSSSGVTLITGKNGTGKSTLL

SEQ ID NO: 4732 - protein, 242 aa, Streptococcus pneumoniae
MSTKYLFIYNEIREKILCNKYTMNEQLPDEMTLAKQFACSRMTIKKALDLLVSEGLIFRKRGQGTFVLSRGSSKRKLIVPERDIRGLTKISEDAHSTIDSRIIHFKLEFANEFLAEKLQVALQSPVYNIYRLRIIDGKPYVLEQTYMSTDVIPGITEDILQKSIYNYIEGKLGLHIASATKILRASSSSENEQHYLQLLPTEPVFEVEQVAYLDNGTPFEYSISRHRYDLFEFNSFALRHSS

SEQ ID NO: 4733 - protein, 469 aa, Streptococcus pneumoniae
MKKKLVFPNLFWWGAASSGPQTEGQYGKVHENVMDYWFKTHPEDFFDNVGPLVASNFFHTYTEDFHLMKEIGVNSFRTSIQWSRLIKNLETGEPDPKGIAFYNAIIEEAKKNQMDLVMNLHHFDLPVELLQKYGGWESKHVVELFVKFAKTAFTCFGDKVHYWTTFNEPMVIPEAGYLYAFHYPNLKGKGKEAVQVIYNLNLASAKVIQLYRSLELDGKIGIILNLTPAYPRSNSPEDLEASRFTDDFFNKVFLNPAVKGTFPERLVKQLERDGVLWSHTEKELQLMKSNTVDFLGVNYYHPKRVQAQANPEEYQTPWMPDQYFKEYEWPERRMNPYRGWEIFPKSIYDIAMIVKEEYGNIPWFISENGMGVENEARFIDENGVIDDVYRIEFYEEHLRWLHKAIEEGSHCFGYHAWTAFDCWSWNNAYKNRYGFISVDLETQKRTIKSSGRWYRKVSDNNGFEVEIEE

SEQ ID NO: 4734 - protein, 431 aa, Streptococcus pneumoniae
MKNSKFIDQFATFAGKLGNQIHLKTLRDAFVTVMPLYILAGLIVLLNNTVFKWIFQGDTLTRFQYWGITIANGTLSISGMIIAVMVGYFLAKNRDFENPLAASMLSLVSLIVMMPNTVSVVPDGAKDAVNISGVLSFNNTGTGAMFAGVIVAIIATELFIELSNVKALQMNLGENIPPAVSRSFSVLLPVMTVISLFGVVSALLFNITGMNLISIITIFIQEPIRHIGTSLIGVIIIYSLGNMLWLFGIHQAVIYSAILEPLLLINITENITAANNGQAIPHIINLSQIQTFALMGGSGSTLCLLIATFLVSRNAVSKNVAKLSFGPGIFNINEPVLFGYPIVYNISLAIPFITVPVLGILISYLATVTGFMSPAFIQVPWTTPVFLNAWLATAGDVRAVLVQFIIFALGVLLYIPFIKVNDKVVEQEMEG

SEQ ID NO: 4735 - protein, 128 aa, Streptococcus pneumoniae
MIEIKFIPVILNNNAETTPNKEMTVMTGSNTLNDLLTAGGIFSPRFICKALTFDNSMNNSVAIIATITPANIAPVPVLLNERTPEMFTASFAPSGTTETVFGIITIKETNDSIDAANGFSKSLFLAKK

SEQ ID NO: 4736 - protein, 102 aa, Streptococcus pneumoniae
MKQILLVCNAGMSTSMLVKKMQQSATERGIEISIQAKSMTEAKKNIHEADVILIGPQIRYELLAVKEIAGNIPVDTIDMRDYGMMNGAKVLEQALAWIGEIR

SEQ ID NO: 4737 - protein, 102 aa, Streptococcus pneumoniae
MTEEMEYICFQLIANSGAAKSSFIEAIQLAKAGNLKEAKIKVEEAEDSLVEAHKIHSNLIQKEATGEKIGFSLLFMHAEDQMASTEIIQLLSKEFIDLYQNK

SEQ ID NO: 4738 - protein, 74 aa, Streptococcus pneumoniae
DSILKRKDYKSSFPSHLFYRDLSLYSLEIKKQHTLSSFYRKPVNEGLVLSAISNQCFELNGTRFLVCSLILIGP

SEQ ID NO: 4739 - protein, 890 aa, Streptococcus pneumoniae
LKAMEENMADKKTVTPEEKKLVAEKHVDELVQKALVALEEMRKLDQEQVDYIVAKASVAALDAHGELALHAFEETGRGVFEDKATKNLFACEHVVNNMRHTKTVGVIEEDDVTGLTLIAEPVGVVCGITPTTNPTSTAIFKSLISLKTRNPIVFAFHPSAQESSAHAARIVRDAAIAAGAPENCVQWITQPSMEATSALMNHEGVATILATGGNAMVKAAYSCGKPALGVGAGNVPAYVEKSANIRQAAHDIVMSKSFDNGMVCASEQAVIIDKEIYDEFVAEFKSYHTYFVNKKEKALLEEFCFGVKANSKNCAGAKLNADIVGKPATWIAEQAGFTVPEGTNILAAECKEVGENEPLTREKLSPVIAVLKSESREDGITKARQMVEFNGLGHSAAIHTADEELTKEFGKAVKAIRVICNSPSTFGGIGDVYNAFLPSLTLGCGSYGRNSVGDNVSAINLLNIKKVGRRRNNMQWMKLPSKTYFERDSIQYLQKCRDVERVMIVTDHAMVELGFLDRIIEQLDLRRNKVVYQIFADVEPDPDITTVNRGTEIMRAFKPDTIIALGGGSPMDAAKVMWLFYEQPEVDFRDLVQKFMDIRKRAFKFPLLGKKTKFIAIPTTSGTGSEVTPFAVISDKANNRKYPIADYSLTPTVAIVDPALVLTVPGFVAADTGMDVLTHATEAYVSQMASDYTDGLALQAIKLVFENLESSVKNADFHSREKMHNASTIAGMAFANAFLGISHSMAHKIGAQFHTIHGRTNAILLPYVIRYNGTRPAKTATWPKYNYYRADEKYQDIARMLGLPASTPEEGVESYAKAVYELGERIGIQMNFRDQGIDEKEWKEHSRELAFLAYEDQCSPANPRLPMVDHMQEIIEDAYYGYKERPGRRK

SEQ ID NO: 4740 - protein, 136 aa, Streptococcus pneumoniae
VENLTNFYEKYRVYLTRPRLEILAVVTIVFCAVLVFFLNIPGKGVLKLDNGTIVYDGSLVRGKMNGQGTITFQNGDQYTGGFNNGAFNGKGTFQSKEGWTYEGDFVNGQAEGKGKLTTEQEVVYEGTFKQGVFQQK

SEQ ID NO: 4741 - protein, 142 aa, Streptococcus pneumoniae
MKKLVFVCLGNICRSPMAEFVMKSMTDNYEIQSRATSSWEHGNPIHKGTQGIFQEYEIPYDKNKTSLQISKEDFEAFDYIIGMDASNVSDLRQMCPVDCQDKIYSFSSESVPDPWYTGDFEETYRRVQEGCQAWLERLEKES

SEQ ID NO: 4742 - protein, 99 aa, Streptococcus pneumoniae
MNPNITFLIMLVGMMALMFFMQRSQKKQAQKRMESLNKLQKGYEVITIGGLYGTVDEVDTEKGTIVLDVDGVYLTFELAAIKTVLPLKETASLEGAIEK

SEQ ID NO: 4743 - protein, 658 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASAPAPKVLAEYGFTVENLVKIVRNLK

SEQ ID NO: 4744 - protein, 80 aa, Streptococcus pneumoniae
WKVSQARQLHMQACKNLISWLFFMIQMISTWMVRQRIPLQKVFVTVTMPTVGILPWLKMEQTWKPSMLLSKQQKLQASHL

SEQ ID NO: 4745 - protein, 101 aa, Streptococcus pneumoniae
LTPLIKPTQVIQVWLWERLRWLTASLQNNFISIQLNQTGLTATALFFQQVMVQCSFMLFFTFLVLKMSAWMRLRASVNGVQKHQVTQNLVIRQGLMLRQVL

SEQ ID NO: 4746 - protein, 244 aa, Streptococcus pneumoniae
VIISTHTQLQQFSTFPKLEHVKFIGLTHCGRIWEGWGVPKERIIVVKAGDTIELKDMKIHAVESFDRTCLVTLPVNGADETGGELAGLAVTDEEMAQKAVNYIFETPGGTIYHGADSHFSNYFAKHGKDFKIDVALNNYGENPVGIQDKMTSIDLLRMAENLRTKVIIPVHYDIWSNFMASTNEILELWKMRKDRLQYDFHPFIWEVGGKYTYPQDQHLVEYHHPRGFDDCFEQDSNIQFKALL

SEQ ID NO: 4747 - protein, 135 aa, Streptococcus pneumoniae
MPNVKEITRESWILATFPEWGTWLNEEIEEEVVPEGNFAMWWLGNCGTWIKTPAGANVVMDLWSNRGKSTKKVKDMVRGHQMANMAGVRKLQPNLRVQPMVIDPFAINELDYYLVSHFHSDHIDPYTVAAILNIS

SEQ ID NO: 4748 - protein, 557 aa, Streptococcus pneumoniae
MVLDKASCDLLQYLMDQETSKTIMAISKDLKESRRKIYYHIDKINAALVDEALHIISIPRIGIHLTEEQRDACCKLLSEVDSYDYIMSAHERMMIMLLWIGISKERITIEKLIELTEVSRNTVLNDLNSIRYQLTLEQYQVTLQVSKSQGYHLHAHPLNKIQYLQSLLYHIFMEENATFVSILEDKMKERLDDECLLSVEMNQFFKEQVPLVEQDLGKKINHHEITFMLQVLPYLLLSCHNVEQYQERHQDIEKEFSLIRKRIEYQVSKKLGERLFQKFEISLSGLEVSLVAVLLLSYRKDLDIHAESDDFRQLKLALEEFIWYFESQIRMEIENKDDLLRNLMIHCKALLFRKTYGIFSKNPLTKQIRSKYGELFLVTRKSAEILEGAWFIRLTDDDIAYLTIHIGGFLKYTPSSQKNMKKVYLVCDEGVAVSRLLLKQCKLYFPNEQIDTVFTTEQFKSVEDIAQVDVVITTNDDLDSRFPILRVNPILEAEDILKMLDYLKHNIFRNKSKSFSENLSSLISSYIVDSKLASKFQEEVQTLINQEIVVQAFLEDI

SEQ ID NO: 4749 - protein, 234 aa, Streptococcus pneumoniae
MNQVINAMRKRVCDANQSLPKHGLVKFTWGNVSEVNRELGVIVIKPSGVDYDELTPENMVVTDLDGKILEGDLRPSSDLPTHVQLYKAWSEIGSVVHTHSTEAVGWAQAGRDIPFYGTTHADYFYGSIPCARSLTKDEVEVAYEKDTGLVIVEEFEHRGLNPVEVPGIVVRNHGPFTWGKNPEDAVYHSVVLEEVSKMNRFTEQINSRVEPAPQYILEKHYQRKHGPNAYYGQK

SEQ ID NO: 4750 - protein, 287 aa, Streptococcus pneumoniae
MVRPIGIYEKATPTHFTWLERLNFAKELGFDFVEMSIDERDERLARLDWSKEERLEVVKAIYETGVRIPSICFSGHRRYPLGSKDPVLEEKSLELMKKCIELAQDLGVRTIQLAGYDVYYEEKSPQTRQRFIKNLRKACDWAEEAQVVLAIEIMDDPFISSIEKYLAIEKEIDSPFLFVYPDIGNVSAWHNDIYSEFYLGHHAIAALHLKDTYAVTESSKGQFRDVPFGQGCVKWEEAFDILKETNYNGPFLIEMWSENCETVEETRAAIQEAQAFLYPLIKKAGLM

SEQ ID NO: 4751 - protein, 221 aa, Streptococcus pneumoniae
MTKRIPNLQVALDHSDLQGAIKAAVSVGQEVDIIEAGTVCLLQVGSELAEVLRSLFPDKIIVADTKCADAGGTVAKNNAVRGADWMTCICCATIPTMEAALKAIKTERGERGEIQIELYGDWTFEQAQLWLDAGISQAIYHQSRDALLAGETWGEKDLNKVKKLIDMGFRVSVTGGLDVDTLKLFEGVDIFTFIAGRGITEAADPAGAARAFKDEIKRIWG

SEQ ID NO: 4752 - protein, 161 aa, Streptococcus pneumoniae
MNLKQALIDNDSIRLGLEANNWKEAVKVAVDPLIESGAILPEYYDAIIESTEEYGPYYILMPGMAMPHARPEAGVQSDAFSLITLQNPVVFSDGKEVSVLLALAATSSKIHTSVAIPQIIALFELEDSIARLQACQTKEDVLAMIEESKDSPYLEGLDLES

SEQ ID NO: 4753 - protein, 93 aa, Streptococcus pneumoniae
MVKVLAACGNGMGSSMVIKMKVENALRKLNQTDFTVNSCSVGEAKGLAVGYDIVIASLHLIQELEGRTNGKLIGLDNLMDDKEITEKLSQALQ

SEQ ID NO: 4754 - protein, 508 aa, Streptococcus pneumoniae
LVFLFALSHYIINLQKQFKRRTIMEVVSSVLNWFSSNILQNPAFFVGLLVLIGYALLKKPAHDVFSGFVKATVGYMLLNVGAGGLVTTFRPILAALNYKFQIGAAVIDPYFGLAAANNKIVAEFPDFVGTATTALLIGFGINILLVALRKITKVRTLFITGHIMVQQAATVSLMVLFLVPQLRNAYGTAAIGIICGLYWAVSSNMTVEATQRLTGGGGFAIGHQQQFAIWFVDKVAGRFGKKEESLDNLKLPKFLSIFHDTVVASATLMLVFFGAILLILGPDIMSNKEVITSGTLFNPAKQDFFMYIIQTAFTFSVYLFVLMQGVRMFVSELTNAFQGISNKLLPGSFPAVDVAASYGFGSPNAVLSGFTFGLIGQLITIVLLIVFKNPILIITGFVPVFFDNAAIAVYADKRGGWKAAVILSFISGVLQVALGALCVALLDLASYGGYHGNIDFEFPWLGFGYIFKYLGIVGYVLVCLFLLVIPQLQFAKAKDKEKYYNGEVQEEA

SEQ ID NO: 4755 - protein, 207 aa, Streptococcus pneumoniae
MLNKIRDYLDFSGLQYRSPDKAGAEREKMLAFRHKGQEARKAFTELAKAFQASHPEWQLQQTSQWMNQAQRLRPHFWVYLQRDGQVTEPMMALRLYGTSTDFGISLEVSFIERKKDEQTLGKQAKVLDIPTVKGIYYLTYSNGQSQRWEANEEKRRTLREKVRSQEVRKVLVKVDVPMTENSSEEEIVEGLLKSYSKILPYYLATRK

SEQ ID NO: 4756 - protein, 328 aa, Streptococcus pneumoniae
MVVFTGSTVEEAIQKGLKELDIPRMKAHIKVISREKKGFLGLFGKKPAQVDIEAISETTVVKANQQVVKGVPKKINDLNEPVKTVSEETVDLGHVVNAIKKIEEEGQGISDEVKAEILKHERHASTILEETGHIEILNELQIEEAMREEAGADDLETEQDQTENQDLKEMGLKVEQSYDIAQVATDVTAYVQAIVDDMDVEATLSNDYNRRSINLQIDTNEPGRIIGYHGKVLKALQLLAQNYLYNRYSKTFYVTINVNDYVEHRAEVLQTYAQKLANRVLEEGRSHKTDPMSNSERKIIHRIISRMDGVTSYSEGDEPNRYVVVDTE

SEQ ID NO: 4757 - protein, 276 aa, Streptococcus pneumoniae
MGVKKKLKLTSLLGLSLLIMTACATNGVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 4758 - protein, 123 aa, Streptococcus pneumoniae
LKKNFRVKREKDFKAIFKEGTSFANRKFVIYQLENQKNHFRVGLSVSKKLGNAVTRNQIKRRIRHIIQNAKGSLVEDVDFVVIARKGVEALGYAEMEKNLLHVLKLSKIYQEGNGSEKETKVD

SEQ ID NO: 4759 - protein, 396 aa, Streptococcus pneumoniae
MTKTIAINAGSSSLKWQLYLMPEEKVLAKGLIERIGLKDSISTVKFDGRSEQQILDIENHTQAVKILLDDLIRFDIIKAYDEITGVGHRVVAGGEYFKESTVVEGDVLEKVEELSLLAPLHNPANAAGVRAFKELLPDITSVVVFDTSFHTSMPEKAYRYPLPTKYYTENKVRKYGAHGTSHQFVAGEAAKLLGRPLEDLKLITCHIGNGGSITAVKAGKSVDTSMGFTPLGGIMMGTRTGDIDPAIIPYLMQYTEDFNTPEDISRVLNRESGLLGVSANSSDMRDIEAAVAEGNHEASLAYEMYVDRIQKHIGQYLAVLNGADAIVFTAGVGENAESFRRDVISGISWFGCDVDDEKNVFGVTGDISTEAAKIRVLVIPTDEELVIARDVERLKK

SEQ ID NO: 4760 - protein, 317 aa, Streptococcus pneumoniae
MDFEKIEQAYTYLLENVQVIQSDLATNFYDALVEQNSIYLDGETELEQVKDNNQTLKRLALRKEEWLKTYQFLLMKAGQTEPLQANHQFTPDAIALLLVFIVEELFTEEEITILEMGSGMGILGATFLTSLDKKVDYLGMEVDDLLIDLAASMADVIGLQAGFVQGDAVRPQMLKESDVVISDLPVGYYPDDAVASRHQVASSQEHTYAHHLLMEQGFKYLKSDGYAIFLAPSDLLTSPQSDLLKVWLKEEASLVAMISLPENLFANAKQSKTIFILQKKNEIAVEPFVYPLASLQDASVLMKFKENFQKWTQGTEI

SEQ ID NO: 4761 - protein, 195 aa, Streptococcus pneumoniae
MKHDFNHKAETFDSPKNIFLANLVCQAVEKQIDILSDKVILDFGGGTGLLALPLAKQAKSVTLVDISEKMLEQARLKVEQQAIKNIQFLEQDLPKNPLEKEFDCLAVSRVLHHMPDLDAALSLFHQHLKEDGKLIIADFTKTEANHHGFDLAELENKLIEHGFSSVHSQILYSAEDLFQGNHSEFFLIVAQKSLA

SEQ ID NO: 4762 - protein, 137 aa, Streptococcus pneumoniae
VWKKKKVKAGVLLYAVTIAAIFSLLLQFYLNRQIAHYQDYALNKEKLVAFAMAKRTKDKVEQESGEQFFNLGQVSYQNKKTGLVTRVRTDKSQYEFLFPSVKIKEEKRDKKEEVATDSSEKVEKKKSEEKPEKKENS

SEQ ID NO: 4763 - protein, 168 aa, Streptococcus pneumoniae
LRFRYFLVKKDWRSTMVQNSCWQSKSHKVKAFTLLESLLALIVISGGLLLFQAMSQLLISEVRYQQQSEQKEWLLFVDQLEAELDRSQFEKVEGNRLYMKQDGKDIAIGKSKSDDFRKTDASGRGYQPMVYGLKSAQITEDNQLVHFRFQFQKGLEREFIYRVEKEES

SEQ ID NO: 4764 - protein, 100 aa, Streptococcus pneumoniae
MEKLNALRKQKIRAVILLEAVVALAIFASIATLLLGQIQKNRQEEAKILQKEEVLRVAKMALQTGQNQVSINGVEIQVFSSEKGLEVYHGSEQLLAIKEP

SEQ ID NO: 4765 - protein, 134 aa, Streptococcus pneumoniae
MIKAFTMLESLLALSLVSILALGLSGSVQSTFAAVEEQIFFMEFEELYRETQKRSVASQQKTSLNLDGQTISNGSQKLPVPKGIQAPSGQSITFDRAGGNSSLAKVEFQTSKGAIRYQLYLGNGKIKRIKETKN

SEQ ID NO: 4766 - protein, 108 aa, Streptococcus pneumoniae
MKKMMTFLKKAKVKAFTLVEMLVVLLIISVLFLLFVPNLTKQKEAVNDKGKAAVVKVVESQAELYSLEKNEDASLSKLQADGRITEEQAKAYKEYHDKNGVANRKVND

SEQ ID NO: 4767 - protein, 347 aa, Streptococcus pneumoniae
MSKLTSFLKMDISQVFRLRRKKLATAKQKNIITLFNNLFSSGFHLVETISFLDRSALLDKQCVTQMRVGLSQGKSFSEMMESLGCSSAIVTQLSLAEVHGNLHLSLGKIEEYLDNLAKVKKKLIEVATYPLILLGFLLLIMLGLRNYLLPQLDSSNIATQIIGNLPQIFLGMVGLVSVLALLALTFYKRSSKMSVFSILARLPFIGIFVQTYLTAYYAREWGNMISQGMELTQIFQMMQEQGSQLFKEVGQDLAQTLKNGREFSQTIGTYPFFRKELSLIIEYGEVKSKLGSELEIYAEKTWEAFFTRVNRTMNLVQPLVFIFVALIIVLLYAAMLMPMYQNMEVNF

SEQ ID NO: 4768 - protein, 313 aa, Streptococcus pneumoniae
MVQEIAQEIIRSARKKGTQDIYFVPKLDAYELHMRVGDERCKIGSYDFEKFAAVISHFKFVAGMNVGEKRRSQLGSCDYAYDHKIASLRLSTVGDYRGHESLVIRLLHDEEQDLHFWFQDIEELGKQYRQRGLYLFAGPVGSGKTTLMHELSKSLFKGQQVMSIEDPVEIKQDDMLQLQLNEAIGLTYENLIKLSLRHRPDLLIIGEIRDSETARAVVRASLTGATVFSTIHAKSIRGVYERLLELGVSEEELAVVLQGVCYQRLIGGGGIVDFASRDYQEHQAAKWNEQIDQLLKDGHITSLQAETEKISYS

SEQ ID NO: 4769 - protein, 123 aa, Streptococcus pneumoniae
MNMYRVIEMYGDFEPWWFLEGWEEDIVASRKFDQYYDALKYYKTCWFRLEQESPLYKSRSDLMTIFWDPEDQRWCDECDEYLQQYHSLALLQDEQVIPDEKLRSGYEKQTSQERNRSCRMKLK

SEQ ID NO: 4770 - protein, 352 aa, Streptococcus pneumoniae
MKAYTYVKPGLASFVDVDKPVIRKPTDAIVRIVKTTICGTDLHIIKGDVPTCQSGTILGHEGIGIVEEVGEGVSNFKKGDKVLISCVCACGKCYYCKKGIYAHCEDEGGWIFGHLIDGMQAEYLRVPHADNTLYHTPEDLSDEALVMLSDILPTGYEIGVLKGKVEPGCSVAIIGSGPVGLAALLTAQFYSPAKLIMVDLDDNRLETALSFGATHKVNSSDPEKAIKEIYDLTDGRGVDVAIEAVGIPATFDFCQKIIGVDGTVANCGVHGKPVEFDLDKLWIRNINVTTGLVSTNTTPQLLKALESHKIEPEKLVTHYFKLSEIEKAYEVFSKAADHHAIKVIIENDISEA

SEQ ID NO: 4771 - protein, 141 aa, Streptococcus pneumoniae
VTENPAPFVFTVSINSFFTVVAFTTGTDARNQDLVTFFEVGNSFPNFFNNPNPFVAKNGTTLASRNIPFDNMEVCSTNSGFYNTHNSVCWLANNWFVYINKRSKSWFNISIGFHKALLRFFICNIYSSIVSLFLCFFKLFL

SEQ ID NO: 4772 - protein, 383 aa, Streptococcus pneumoniae
MPNYIKADQFFYPHGVRRGGYLELVDGKFGKHVEQIPEGAEVIDYTGYSIAPGLVDTHIHGYAGVDVMDNNIEGTLHTMSEGLLSTGVTSFLPTTLTATYEQLLAVTENLGNHYKEATGAKIRGIYYEGPYFTETFKGAQNPTYMRDPGVEEFHSWQKAANGLLNKIALAPERDGVEDFVRTVTGEGVTVALGHSNATFDEAKKAVDAGASVWVHAYNGMRGLTHRELGMVGAMYQLPHTYAELICDGHHVDPKACEILIKQKGTENIALITDCMTAGGLEDGDYMLGEFPVVVANGTARLKSTGNLAGSILKLKDGLKNVVEWGIANPHEAVMMASFNPAKSVHIDDVCGQIREGYDADFIVLDKDLELVATYLDGVKRYQA

SEQ ID NO: 4773 - protein, 605 aa, Streptococcus pneumoniae
MRIKWFSLIRIIGLLLVLLYHFFQTIFPGGFFGVDVFFTFSGFLITALLIEEFSKNHEIDLIGFFRRRFYRIVPPVVLMVLVTMPFTFLVRQDYVAGIGGQIASVLGFMTNFYELLTGGSYESQFHPHLFVHNWSLAVEVHYYILWGLAVWFLSTHAKSNGQLKGMVFLLSAVAFLISFFSMFIGSFLVTSYSSVYFSSLTHVYPFFLGSMLATIVGVRQTTSLVKQLDKIWDLRKTLVVFGGGFGFLVLLTFFVKFTYLFAYLIGFLLASLAALAMILAARVLHEKTHHIQEPKIISFLADTSYAVYLFHWPFYIIFSQLTSNLLAVLLTLICSYGFASLSFYVLEPWIAGKNTPIVQTLRPLPYIHAILAAGTGILTIIVCTVTLLAPQVGAFETDLTVNGLKQAATNIGQTKVMAERADANSLGIADGTMLIGDSVALRANTALQTALPGAQINAQVSVTTKTANEIMLNNSQNKFLPKTVVIATGVNNPENYKDDWDSIVKNLPKGHHMILVTPYEGDKTKETYAIVEKAAAYMRELAEKTPYITIADWNQVAKEHPEIWAGTDQVHFGSESSTIEAGAKLYADTIATALQTAQDKPVKSK

SEQ ID NO: 4774 - protein, 380 aa, Streptococcus pneumoniae
MSDSPIKYRLIKKEKHTGARLGEIITPHGTFPTPMFMPVGTQATVKTQSPEELKEMGSGIILSNTYHLWLRPGDELIARAGGLHKFMNWDQPILTDSGGFQVYSLADSRNITEEGVTFKNHLNGSKMFLSPEKAISIQNNLGSDIMMSFDECPQFYQPYDYVKKSIERTSRWAERGLKAHRRPHDQGLFGIVQGAGFEDLRRQSAHDLVSMDFSGYSIGGLAVGETHEEMNAVLDFTTQLLPENKPRYLMGVGAPDSLIDGVIRGVDMFDCVLPTRIARNGTCMTSQGRLVVKNAQFAEDFTPLDPECDCYTCNNYTRAYLRHLLKADETFGIRLTSYHNLYFLLNLMKQVRQAIMDDNLLEFREYFVEKYGYNKSGRNF

SEQ ID NO: 4775 - protein, 285 aa, Streptococcus pneumoniae
MNYPKIDLKTIRQESKHFQADTPRLFLLYILPSMLVILSGFLNPLSRIHGTVLEQPFFSILGQILQTYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQHFVLDLQLLPWYFLNWITFGIASFSLLPYIQCTKIMFYRAVLARKRPKA

SEQ ID NO: 4776 - protein, 214 aa, Streptococcus pneumoniae
MKVLVTGFEPFGGEKGNPALEAIKGLPAEIHGAEVRWLEVPTVFHKSAQVLEEEMNRYQPDFVLCIGQAGGRTSLTPERVTINQDDACISDNEDNQPIDRPIRPDGASAYFSSLPIKAMVQAIKKEGLPASVSNTAGTFVCSHLMYQALYLVEKKSPYVKAGFMHIPYMMEQVVNRPTTPAMSLVDIRRGIEAAIGAIIEHGDQELKLVGGETH

SEQ ID NO: 4777 - protein, 89 aa, Streptococcus pneumoniae
WPPKLDCPFPLQRAQNLSLILSFLTPQNQFNETFFLKTSITYFPYSGLKRISEIRIDLQVYLKSKILIKAKIADPPCFKIIFLSAVKEP

SEQ ID NO: 4778 - protein, 119 aa, Streptococcus pneumoniae
MSIILTTIVALEHFYIFYLESIATQSDATSRVFNMEKEELAHPSVSSLFKNQGIYKALLGVFLLYVIYFSQNLEIVTIFVLFVIGAATYGSLTADKKIILKQGGSAILALISILLFKYT

SEQ ID NO: 4779 - protein, 141 aa, Streptococcus pneumoniae
MLEIQDLLYQLRLSEQASTQLFEKRLGISLTRYQILLFLLEHSPCNQMAVQERLKIDQAALTRHFKILETEGLVERHRNPENQREVLVEAAKYAKEQLVVNPPLQHIRVKEEIESILTEFERTELSRLLNKLVLGIENIEI

SEQ ID NO: 4780 - protein, 68 aa, Streptococcus pneumoniae
DLAFVMESDSRSFFLCHTLRKSLQTTSVLSETSKLCFEQPATSFLVCFLIFIEYQFEWKMESYHLVMS

SEQ ID NO: 4781 - protein, 370 aa, Streptococcus pneumoniae
MKKRMLLASTVALSFAPVLATQAEEVLWTARSVEQIQNDLTKTDNKTSYTVQYGDTLSTIAEALGVDVTVLANLNKITNMDLIFPETVLTTTVNEAEEVTEVEIQTPQADSSEEVTTATADLTTNQVTVDDQTVQVADLSQPIAEVTKTVIASEEVAPSTGTSVPEEQTTETTRPVEEATPQETTPAEKQETQASPQAASAVEVTTTSSEAKEVASSNGATAAVSTYQPEETKIISTTYEAPAAPDYAGLAVAKSENAGLQPQTAAFKEEIANLFGITSFSGYRPGDSGDHGKGLAIDFMVPERSELGDKIAEYAIQNMASRGISYIIWKQRFYAPFDSKYGPANTWNPMPDRGSVTENHYDHVHVSMNG

SEQ ID NO: 4782 - protein, 206 aa, Streptococcus pneumoniae
MQKTAFIWDLDGTLLDSYEAILSGIEETFAQFSIPYDKEKVREFIFKYSVQDLLVRVAEDRNLDVEVLNQVRAQSLAEKNAQVVLMPGAREVLAWADESGIQQFIYTHKGNNAFTILKDLGVESYFTEILTSQSGFVRKPSPEAATYLLDKYQLNSDNTYYIGDRTLDVEFAQNSGIQSINFLESTYEGNHRIQALADISRIFETK

SEQ ID NO: 4783 - protein, 426 aa, Streptococcus pneumoniae
LFKKNKDILNIALPAMGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTIVSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 4784 - protein, 494 aa, Streptococcus pneumoniae
MTLVYQSTRDANNTVTASQAILQGLATDGGLFTPDTYPKVDLNFDKLKDASYQEVAKLVLSAFLDDFTVEELDYCINNAYDSKFDTPAIAPLVKLDGQYNLELFHGSTIAFKDMALSILPYFMTTAAKKHGLENKIVILTATSGDTGKAAMAGFANVPGTEIIVFYPKDGVSKIQELQMTTQTGDNTHVIAIDGNFDDAQTNVKHMFNDVALREKLTTNKLQFSSANSMNIGRLVPQIVYYVYAYAQLVKTGEIVAGEKVNFTVPTGNFGNILAAFYAKQIGLPVGKLICASNDNNVLTDFFKTRVYDKKREFKVTTSPSMDILVSSNLERLIFHLLGNNAEKTTELMNALNTQGQYKLTDFDAEILDLFAAEYATEEETAAEIKRVCELDSYIEDPHTAVASAVYKKYQSATGDVTKTVIASTASPYKFPVVAVEAVTGKAGLTDFEALAQLHEISGVAVPPAVDGLEIAPIRHKTTVAAADMQAAVEAYLGL

SEQ ID NO: 4785 - protein, 425 aa, Streptococcus pneumoniae
MSCSIDLLKHRYLKNIKENPELFVGIELEYPVASLEGDATDVEVMKDLFHYLVSTLDLTVAKVDDFGNLIQLVDPISQDAILFEVSYTTIEFAFGKAETIQEVENRFNNYMNVIQRKLAESNHAIVGCGIHPNWDKNENCPVAYPRYQMLMDYLNLSRNIIKSDLHHFPEYGTFICGSQVQLDISKTNYLRVINAFTQIEAAKAYLFANSEFSGADWDTKISRDIFWEESMHGIYPENVGVNARLLNDETDFFDYLNHSAIFTAERDGQTYYFYPIQAGDYLATSEIQAFALNGDEVIIYPQEKDFETHRSYQYQDLTTRGTVEFRSVCTQPLDRTFASAAFHLGLLVNLDKLEAYLETAPFFKVFGYDYKSLRRQFSKKNLTDEEETTIIEFSKDLLLLAEEGLVVRNKEEMTYLQPLREELSL

SEQ ID NO: 4786 - protein, 58 aa, Streptococcus pneumoniae
IPAAGVEPARPCGHWILSPARLPIPPRRQIVTGVAGFEPTHEGVKVPCLTAWLYPNIK

SEQ ID NO: 4787 - protein, 60 aa, Streptococcus pneumoniae
MGTSGLEPPTSRLSGVRSNHLSYAPKSKTWYKEQSSKRVTRIELATTAWKAVVLPLNYTR

SEQ ID NO: 4788 - protein, 77 aa, Streptococcus pneumoniae; identical to SEQ ID NO: 2935

SEQ ID NO: 4789 - protein, 81 aa, Streptococcus pneumoniae; identical to SEQ ID NO: 2934

SEQ ID NO: 4790 - protein, 51 aa, Streptococcus pneumoniae
LTQFTPYCLDRLFQSSALVSLLGPFITTYSSTGISTCCPSDTPFGLFLGPE

SEQ ID NO: 4791 - protein, 104 aa, Streptococcus pneumoniae
VEPFIGMVRTPFQRVKKGTRWELLERIKLRIPGIRSESRVRILVPRKPKVSRGRWSALGYSGPKKRPKGVSDGQQVDIPVLEYVVMKGPSRLTKADDWKSLSKQ

SEQ ID NO: 4792 - protein, 145 aa, Streptococcus pneumoniae
MSPLGSFQPRGEDTKIKNYCLLVLTDRRSRHQIIRLIPNKTAESVNQALTLLLGEHRILSITADNGSEFKRLSEVFPEEHIYYAHAYSSWERGSNENHNRLIRRWLPKGTKKTTPKEVAFIENWINNYPKKCLDYKSPSEFLLGG

SEQ ID NO: 4793 - protein, 353 aa, Streptococcus pneumoniae
MNKRVQAFLAKMQEKELDGVIINNLKNVYYLTGFWGSNGTVFISRDRQVLVTDSRYIIAAKQETSGFEIVADRDELAVIAGIVKDMGLTRIGFEDEISVSYYHRMQAAFAGLDLFPQTQFVEGLRMIKDEAEIAAIRKACSISDQAFRDALDFIKPGKTEIEIANFLDFRMRELGASGLSFDTILASGINSSKPHAHPMHKPVELGEAITMDFGCLYDHYVSDMTRTIYLGHVSDEQAEIYNTVLKANQALIDQAKAGLGFRDFDKIPRDIIIEAGYGDYFTHGIGHGIGLDIHEEPYFSQTSTETIKTGMALTDEPGIYIEGKYGVRIEDDILITETGCELLTLAPKELIVI

SEQ ID NO: 4794 - protein, 943 aa, Streptococcus pneumoniae
MQDKIVIHGARAHNLKNIDVEIPRDKLVVVTGLSGSGKSSLAFDTLYAEGQRRYVESLSAYARQFLGNMEKPDVDAIDGLSPAISIDQKTTSKNPRSTVGTTTEINDYLRLLYARVGTPYCINGHGAINASSVEQIVDKVLELPERQRLQILAPVIRKKKGQHKSVIEKVQKDGYVRVRVDGEVYDVTEVPELSKSKQHNIDVVVDRIVIKEGIRSRLFDSIEAALRIAEGYVIIDTMDDSELLFSEHYACPVCGFTVPELEPRLFSFNAPFGSCSECDGLGIKLEVDTDLVVPDASKTLREGALAPWNPISSNYYPNMLEQAMKVFGVAMDKPFEDLSEEDKNLILYGSDGKEFHFHYENEFGGVRDIDIPFEGVINNIKRRYHETNSDYTRTQMRLYMNELTCGTCQGYRLNDQALSVRVGGQQGPHIGEISDLSIADHLDLVSQLTLSENEAIIARPILKEIKDRLTFLNNVGLNYLTLSRSAGTLSGGESQRIRLATQIGSNLSGVLYILDEPSIGLHQRDNDRLIASLKKMRDLGNTLIVVEHDEDTMREADYLIDVGPGAGVFGGEIVAAGTPKQVARNSKSITGQYLSGKRVIPVPEERRVGNGRFIEVIGARENNLQNVTARFPLGKFIAVTGVSGSGKSTLINSILKKAIAQKLNRNSDKPGKFKTITGIEHVDRLIDIDQSPIGRTPRSNPATYTGVFDDIRDLFAQTNEAKIRGYKKGRFSFNVKGGRCEACSGDGIIKIEMHFLPDVYVACEVCHGTRYNSETLEVHYKEKNISQVLDMTVNDAVEFFQHIPKIQRKLQTIKDVGLGYVTLGQPATTLSGGEAQRMKLASELHKRSTGKSFYILDEPTTGLHTEDIARLLKVLARFVDDGNTVLVIEHNLDVIKTADHIIDLGPEGGVGGGTIIVTGTPEEVAANEASYTGHYLKGKLHHE

SEQ ID NO: 4795 - protein, 314 aa, Streptococcus pneumoniae
MKQVFLCTTTEFKEIDTLEPGTWINLVNPTQNESLEIANTFDIDIADLRAPLDAEEMSRITIEDEYTLIIVDVPVTEERNNRTYYVTIPLGIIITEETIITTCLEPLPVLDVFINRRLRNFYTFMRSRFIFQILYRNAELYLTALRSIDRKSEQIESQLHQSTRNEELIELMELEKTIVYFKASLKTNERVIKKLTSSTSNIKKYLEDEDLLEDTLIETQQAIEMADIYGNVLHSMTETFASIISNNQNNIMKTLALVTIVMSIPTMVFSAYGMNFKDNEIPLNGEPNAFWLIVFIAFAMSVSLTLYLIHKKWF

SEQ ID NO: 4796 - protein, 67 aa, Streptococcus pneumoniae
MSQIDLQKLTKKNQEFVHIATQQFIKDGKTDAEIQTIFEEVIPQILEEQSKGTTARSLYGAPTHWGS

SEQ ID NO: 4797 - protein, 212 aa, Streptococcus pneumoniae
LSTLLPNNSSKMGKQTLKSRLFLRKSFPKSLRSNLKVQLPVPYTAHQLIGAHSFTVKEQYEKEHPKENDDPKLMIMDSALFITSLFALVSALTTFFAADQAFGYGLITLLLVGLVGGFAFYLMYYFVYQYYGPDMDRSQRPPFWKSVLVILASMFLWLLVFFATSFLPASLNPVLDPLPLAIIGAALLALRFYLKKRLNIRSASAGPTRYQE

SEQ ID NO: 4798 - protein, 50 aa, Streptococcus pneumoniae
VGFQKNTFNTLRKSLQTTSVLSATSKLCFEQPAASFLVCSLIFIEYNSKK

SEQ ID NO: 4799 - protein, 343 aa, Streptococcus pneumoniae
MVSTIGIVSLSSGIIGEDFVKHEVDLGIQRLKVLGLNPIFLPHSLKGLDFIKDHPEARAEDLIHAFSDDSIDMILCAIGGDDTYRLLPYLFENDQLQKAIKQKIFLGFSDTTMNHLMLHKLGIKTFYGQSFLADICELDKEMLAYSLHYFKELIETGRISEIRPSDVWYEERTDFSPTALGTPRVSHTNTGFDLLQGSAQFEGKILGGCLESLYDIFDNSRYADSTELCQKYKLFPDLSDWEGKILLLETSEEEPKPEDFKKMLLTLKDTGIFAVINGLLVGKPMDETFHDDYKEALLDIIDNNIPIVYNLNVGHATPRAIVPFGVHAHVDAQEQVIRFDYNK

SEQ ID NO: 4800 - protein, 225 aa, Streptococcus pneumoniae
MMSNKNKGILIFAILYTVLFVFDGVKLLASLMPSVIANYLVYVVLALYGSFLFKDRLIQQWKEIRKTKRKFFFGVLTGWLFLILMTVVFEFVSEMLKQFVRLDGQGLNQSNIQSTFQEQPLLIAVFACVIGPLVEELFFRQVLLHYLQERLPGLLSIILVGLVFALTHMHSLALSEWIGAVGYLGGGLAFSIIYVKEKENIYYPLLVHMLSNSLSLIILAISIVK

SEQ ID NO: 4801 - protein, 187 aa, Streptococcus pneumoniae
MTKRCSWVKMTNPLYIAYHDEEWGQPLHDDQALFELLCMETYQAGLSWETVLNKRQAFREAFHSYQIHSVAEMTDTELEAMLENPAIIRNRAKIFATRANAQAFLQLQAEYGSFDAYLWSFVEGKIVVNDVPDYRQAPAKTPLSEKLAKDLKKRGFKFTGPVAVLSFLQAAGLVDDHENDCEWKGLK

SEQ ID NO: 4802 - protein, 185 aa, Streptococcus pneumoniae
VNLIAMKCFSESLAFVEYRFPRQACLIGFHTQQLKQCLVIMEGLAPLLIMIGDVERVGHLDPRTTFCHSLLLFDQHFKGRLDIVLSCICRSFKEFLDFLELCCLVAQSQHGFHSFFQFLVFSTCLHCDLGRKVISCNYYLAFQVQHHLLGCFLANFRELGQVGDVLGFNGLNQASIVISSDNSKS

SEQ ID NO: 4803 - protein, 197 aa, Streptococcus pneumoniae
MYAYLKGIITKITAKYIVLETNGIGYILHVANPYAYSGQVNQEAQIYVHQVVREDAHLLYGFRSEDEKKLFLSLISVSGIGPVSALAIIAADDNAGLVQAIETKNITYLTKFPKIGKKTAQQMVLDLEGKVVVAGDDLPAKVAVQASAENQELEEAMEAMLALGYKATELKKIKKFFEGTTDTAENYIKSALKMLVK

SEQ ID NO: 4804 - protein, 69 aa, Streptococcus pneumoniae
MTSNHFRARKKHKYTFIFFHPDYTVGFGISPNHAFRLVGYTTGRELHPALKIVIQLQMIIVLNFEYVNR

SEQ ID NO: 4805 - protein, 366 aa, Streptococcus pneumoniae
MSDSKYMKLAIKLAQKGAGYVNPNPMVGAIIVKDNHIIGQGYHEFFGGPHAERNALKNCRKSPVGATLYVTLEPCCHFGKTPPCIDAIIDSGITRVVIGSLDCNPIVSGKGVKILEENNLQVTVGILENECLNLIKSFRKYITQHVPYVFMKYAMSMDGKIATKTNQSKWITEEEARKHVHQLRHHVSAIMVGVNTVIQDDPLLTCRLEEGKNPIRIICDTHLRTPLTSKIVKTANDIKTYIATSSEDKNKMKLYQNHGCEILSIKKKGNHIDLSSLMQHLGNMQIDSLVLEGGSLMNWSALEQQIVDELKIYIAPKIFGGSAKFPVGGEGISLPNDAIRLKPYAFSQIGNDYLIESEVIYPCSQE

SEQ ID NO: 4806 - protein, 211 aa, Streptococcus pneumoniae
MFTGIIEEIGKVERIQKDSRNCKLSIKASKILTDIHLGDSIAVNGICLTVTHFNHQSFTVDVMNETWSRTALTLLKHGSEVNLERALSVNGRLGGHVVTGHIDGTGKISSIKKDDNAVWYQINTQKEILDLIVEKGSITIDGISLTVAKVSKVNFSVSVIPHTLEQTILKSKQVGSTVNLENDILGKYVQKLMDNSPKSEISKELLYQNGF

SEQ ID NO: 4807 - protein, 411 aa, Streptococcus pneumoniae
MDFSRKDNQSMEYRKIQEALEALQKGRLVLVIDDKDRENEGDLICSAQAATTENVNFMATYAKGLICMPMSESLANQLMLSPMVENNTDNHKTAFTVSIDYKETTTGISAEERGLTARMCVAEDITPSDFRRPGHMFPLIAKKGGVLERNGHTEATVDLLKLAGLKECGLCCEIMNHDGKMMRTDDLIQFSKKHNIPLITIKELQEYRKVYDQLIERVSTVNMPTRYGNFKAISYIDKLNGEHHLALIMGNIEDEANVLCRVHSECLTGDVLGSLRCDCGQQFDKAMKMIVENGSGVLLYLRQEGRGIGLINKLKAYHLQDQGMDTLDANLALGFEGDLREYHIGAQMLKDLGLQSLHLLTNNPDKVEQLEKYGITISSRISIEIEANPYDSFYLETKKNRMGHILNMEEK

SEQ ID NO: 4808 - protein, 155 aa, Streptococcus pneumoniae
MNTYEGNLVANNIKIGIVVARFNEFITSKLLSGALDNLKRENVNEKDIEVAWVPGAFEIPLIASKMAKSKKYDAIICLGAVIRGNTSHYDYVCSEVSKGIAQISLNSEIPVMFGVLTTDTIEQAIERAGTKAGNKGSECAQGAIEMVNLIRTLDA

SEQ ID NO: 4809 - protein, 649 aa, Streptococcus pneumoniae
MSHIIELPEMLANQIAAGEVIERPASVVKELVENAIDAGSSQIIIEIEEAGLKKVQITDNGHGIAHDEVELALRRHATSKIKNQADLFRIRTLGFRGEALPSIASVSVLTLLTAVDGASHGTKLVARGGEVEEVIPATSPVGTKVCVEDLFFNTPARLKYMKSQQAELSHIIDIVNRLGLAHPEISFSLISDGKEMTRTAGTGQLRQAIAGIYGLVSAKKMIEIENSDLDFEISGFVSLPELTRANRNYISLFINGRYIKNFLLNRAILDGFGSKLMVGRFPLAVIHIHIDPYLADVNVHPTKQEVRISKEKELMTLVSEAIANSLKEQTLIPDALENLAKSTVRNREKVEQTILPLKENTLYYEKTEPSRPSQTEVADYQVELTDEGQDLTLFAKETLDRLTKPAKLHFAERKPANYDQLDHPELDLASIDKAYDKLEREEASSFPELEFFGQMHGTYLFAQGRDGLYIIDQHAAQERVKYEEYRESIGNVDQSQQQLLVPYIFEFPADDALRLKERMPLLEEVGVFLAEYGENQFILREHPIWMAEEEIESGIYEMCDMLLLTKEVSIKKYRAELAIMMSCKRSIKANHRIDDHSARQLLYQLSQCDNPYNCPHGRPVLVHFTKSDMEKMFRRIQENHTSLRELGKY

SEQ ID NO: 4810 - protein, 83 aa, Streptococcus pneumoniae
LAQLTSPCCPRHFLAITNQAKRNLRMGQAQTVDNINDMRQLRLLALHILETGRRVEKEILHTNLGSHRTSRWDDFLNFTPTRD

SEQ ID NO: 4811 - protein, 96 aa, Streptococcus pneumoniae
LIFYLTGRMATQGQLHLIVGNSMTVIRDLNLLETSFLNLNDNLTRARVNGIFYQLFDHTGRTFNDLSSCDLVCQHLWQFNNMRHLSAPFCIYFPRN

SEQ ID NO: 4812 - protein, 60 aa, Streptococcus pneumoniae
LLTLSVLSTTSKQYFELSAPSFLVCSLIFIEYTTILLPLARDFVYVEGLGSYVVELFCSF

SEQ ID NO: 4813 - protein, 173 aa, Streptococcus pneumoniae
LKRFLKSINKGVQEVRLILYEKQGEKFMKVELQISETYEEEKLIVQAPQPTDKVQKVIEFAENLDQREKIKGKSDDQVYLVEIGKIQRFYIENRKVLAETASQTYSIDLRLYQVPKLLPSNFIQISQSEIINIDSISHLKLTPNGLVEIFLKNESFTYSSRRYLKTIKEKLEL

SEQ ID NO: 4814 - protein, 152 aa, Streptococcus pneumoniae
MKKQVFHDAATGVLIGLILSILFSLIYAPNTYAPLNPYSLIGQVMDQHQVHGALVLLYCTLIWATIGMLFNFGNRLFSRDWSMLRATLTHFFLMLAGFVPLATLAGWFPFHWIFYLQLIIEFAIVYLIIWAILYKREAKKVDHINQLLEHRK

SEQ ID NO: 4815 - protein, 125 aa, Streptococcus pneumoniae; identical to SEQ ID NO: 3173

SEQ ID NO: 4816 - protein, 210 aa, Streptococcus pneumoniae; identical to SEQ ID NO: 3174

SEQ ID NO: 4817 - protein, 200 aa, Streptococcus pneumoniae
MSQAISLNQSTWASKLKAMGPGILMATAAVGGSHIVSSTQAGGSYGWSLLLLVILANVFKYPFFRFGAEYTADTGKTLVEGYAEKGKLYLWIFFILNVFSAMVNTAGVAILCSAIIASAFPMIGLSITQWSLILVAIIWAMLLFGGYKLLDGMVKWIMSALTIATVLAVIIAAVKHPEYSSDFVEKTPWQMAALPSSSPS

SEQ ID NO: 4818 - protein, 63 aa, Streptococcus pneumoniae
VLKSNRASSVLKLTVFLFSADQSELMAEISIGAGIHPRRETMKAELPFAKVSSRQNQNCILDA

SEQ ID NO: 4819 - protein, 217 aa, Streptococcus pneumoniae
MPAPIEISAINSLWSAEKRKTVNFNTEDALFDFNTGYIGTAILAVFFVALGALIQYPTGQAVEAASAKYISQFVGMYASVLGEWSRYLITFIAFLCIFGTVITVIDGYSRVNQESLRLLISQKEDNRKSLNIWMTITAIIGIVIIKFFAGQVSTMLRFAMIGSFLTTPFFALLNYALVTRENKNLPSWLKHLAIAGLIFLFGFAIFFIYALAIGKAG

SEQ ID NO: 4820 - protein, 200 aa, Streptococcus pneumoniae
VATTESLGRRRGNRRAYLSIDKKELSRYNLGSCFLIIDKIMEVHMKTISLVYISLSGNTESFVTRLKDYLLSQYKGIEVQKIHIKDLVKEGKNFYEMDHPYVAFLPTYLEGGNGVDNGDVEILTTPVGDFIAYGNNASKCFGVVGSGNRNFNNQYCLTAKQYSQRFGFPVLADFEMRGMLEDIKHVAAIIADLYELEKEN

SEQ ID NO: 4821 - protein, 193 aa, Streptococcus pneumoniae
LYSFTKGAIILSGGPIMKKKPIYLWVLLILSALISVPSLFGIVSPLPSKEALRAAQKQVAGVNAQQLEDQLNYTYRVAEASHSIFNVALIVLSTILVVVAIVFLVRKNLQYANYTYVGYVLLAIIGSIYGYVGLQDAVQLVQDESMRLTVSIGSKAVSIFYIVINVLFLALVFYKMWRQQKALAEEEETEELT

SEQ ID NO: 4822 - protein, 428 aa, Streptococcus pneumoniae
MYKVLLVDDEYMVTEGLKRLIPFDKWDMEVVATASHADEALEYVQENPVDVIISDVNMPDKTGLDMIREMKEILPDAAYILLSGYQEFDYVKRAMNLSVVDYLVKPVDKVELGNLLEKIAGQLGERGKKSQTLSQELDEAGFVSYLGDKENWWIGLSKEKQGSFTIPYYVLGQDWQIFISGQPLDGLVVTPFEAPYQEHFERWKLNAEKTLFYGSVNLQQSESLFAYYEPIYRVIIQGNLNQIVEELNLLEKVVLENTPRVPITKQLFIQFVMDVFHLFEHLKADDLTDIVKTIHAIQSFDELVSYIKETLISFFGQYRMNENVVSVLEVIGRDYQKELSLKDISKALFINPVYLGQLIKRETDSTFAELLNKQRIKAAQQLLLSTSDSIEDICYAVGYSNLGYFYKVFRKLCGKSPKAYRKQVETIL

SEQ ID NO: 4823 - protein, 567 aa, Streptococcus pneumoniae
VICWNLSMKSSMKNWRQNRMKQFWLHTLLRTYSSVMIIIIASFAILLSYADWDSREKEAQRVAQRVTARTVSEIEYYHRESTQIAQALVENQARIEGIYKYFSLSMPDYFYWQLERKASPYISVSLYENVDDLYVRNDFVTGVAIAFQDYKEVYVSTKDKRSGEKIRAEDFKPAGNSFAIPVSDPVSDQDLGVIYISLDPAVLYHAIDNTRGHTPMAVTVTSPFDTEIFHIGETVDRESENWLVGLTSHGYQVQVAVPKNFVLQGTVTSSALIVGLSLLFIVILYLTLRQTFANYQKQVVDLVESIQVIAQGEEGRRIDISEKDQELLLIAETTNDMLDRLEKNIHDIYQLELSQKDANMRALQAQINPHFMYNTLEFLRMYAVMQSQDELADIIYEFSSLLRNNISDERETLLKQELEFCRKYSYLCMVRYPKSIAYGFKIDPELENMKIPKFTLQPLVENYFAHGVDHRRTDNVISIKALKQDGFVEILVVDNGRGMSAEKLANIREKLSQRYFEHQASYSDQRQSIGIVNVHERFVLYFGDRYAITIESAEQAGVQYRITIQDE

SEQ ID NO: 4824 - protein, 204 aa, Streptococcus pneumoniae
MGRFLDFVFNRFFLGMIATAFFWLLTLAGGIILGLAPASATLMSLYAEHGYSFREYSLKEAWSLYKQNFVSSNLIFYSFLGVGLVLTYGLYLLVQLPHQTIVHLIATLLNVLVVALIFLAYTVSLKLQVYFALSYRNSLKLSLIGIFMSLAAVAKVLLGTVLLVAIGYYMPALLFFVGIGMWHFFISDMLEPVYEIIHEKLATK

SEQ ID NO: 4825 - protein, 189 aa, Streptococcus pneumoniae
MKKSILTTLLFAVLYFLCMGIGVLLGNLFDQTGNMFYAPAFTALVGGSVYMILVAKVPRFGAITTIGLVIAFFFLGTKHGAGSFLPGIICGLLADEVAHLGKYKDKTKNFLSFIIFAFSTTGPILLMWIAPKAYMATLLARGKSQEYIDRIMVTPNPGTVLLFIASIVIGALVGALIGQALSKKFAQKI

SEQ ID NO: 4826 - protein, 230 aa, Streptococcus pneumoniae
MESLIQTYLPNVYKMGWAGQAGWGTAIYLTLYMTVLSFIIGGFLGLVAGLFLVLTAPGGVLENKVVFWILDKITSIFRAVPFIILLAILSPLSHLIVKTSIGPNAALVPLSFAVFAFFARQVQVVLAELDGGVIEAAQASGATFWDIVGVYLSEGLPDLIRVTTVTLISLVGETAMAGAVGAGGIGNVAIAYGFNRYNHDVTILATIIIILIIFAIQFLGDFLTKKLSHK

SEQ ID NO: 4827 - protein, 353 aa, Streptococcus pneumoniae
MSRDIIKLDQIDVTFHQKKRTITAVKDVTIHIQEGDIYGIVGYSGAGKSTLVRVINLLQKPSAGKITIDDDVIFDGKVTLTAEQLRRKRQDIGMIFQHFNLMSQKTAEENVAFALKHSELSKEEKKAKVAKLLDLVGLADRAENYPSQLSGGQKQRVAIARALANDPKILISDESTSALDPKTTKHILALLQDWNQKLGLTVVLITHEMQIVKDIANRVAVMQDGHLIEEGSVLEIFSNPKQPLTQDFISTATGIDEAMVKIEKQEIVEHLSENSLLVQLKYAGASTDEPLLNELYKHYQVMANILYGNIEILDGTPVGELVVVLSGEKAALAGAQEAIRQAGVQLKVLKGVQ

SEQ ID NO: 4828 - protein, 72 aa, Streptococcus pneumoniae
LAMSLTICISCVIKTTVKPNFWFQSCNKAKICLVVFGSRAEVDSSEIKIFGSLAKARAIATRCFCPPDSCEG

SEQ ID NO: 4829 - protein, 457 aa, Streptococcus pneumoniae
MVFPSEQEQIEKFEKDHVVQHYFEVLRTLISKKSVFAQQVGLKEVANYLGEIFKRVGAEVEIDESYTAPFVMAHFKSSRPDAKTLIFYNHYDTVPADGDQVWTEDPFTLSVRNGFMYGRGVDDDKGHITARLSALRKYMQHHDDLPVNISFIMEGAEESASTDLDKYLEKHADKLHGADLLVWEQGTKNALEQLEISGGNKGIVTFDAKVKSADVDIHSSYGGVVESAPWYLLQALQSLRAADGRILVEGLYEEVHEPNEREMALLETYGQRNPEEVSRIYGLELPLLQEERMAFLKRFFFEPALNIEGIQSGYQGQGVKTILPAEASAKLEVRLVPGLEPHDVLEKIRKQLDKNGFDKVELYYTLGEMSYRSDMSAPAILNVIELAKKFYPQGVSVLPTTAGTGPMHTVFDALEVPMVAFGLGNANSRDHGGDENVRIADYYTHIELVEELIRSYE

SEQ ID NO: 4830 - protein, 284 aa, Streptococcus pneumoniae
MKIKKWLGLAALATVAGLALAACGNSEKKADNATTIKIATVNRSGSEEKRWDKIQELVKKDGITLEFTEFTDYSQPNKATADGEVDLNAFQHYNFLNNWNKENGKDLVAIADTYISPIRLYSGLNGSANKYTKVEDIPANGEIAVPNDATNESRALYLLQSAGLIKLDVSGTALATVANIKENPKNLKITELDASQTARSLSSVDAAVVNNTFVTEAKLDYKKALFKEQADKNSKQWYNIIVAKKDWETSPKADAIKKVIAAYHTDDVKKVIEESSDGLDQPVW

SEQ ID NO: 4831 - protein, 65 aa, Streptococcus pneumoniae
MELLKNCLNNSSETLIYRQKLILNNFLKSSILSKVGDFSVFRDIVLNYISDYLITICEIKQIVRY

SEQ ID NO: 4832 - protein, 183 aa, Streptococcus pneumoniae
QLTVSKMDVTNISTTKERAEKYIYAATIAQNHNVLVVKKDDSSIKSLDDIGGKSTEVVQATTSAKQLEAYNAEHTDNPTILNYTKADFQQIMVRLSDGQFDYKIFDKIGVETVIKNQGLDNLKVIELPSDQQPYVYPLLAQGQDELKSFVDKRIKELYKDGTLEKLSKQFFGDTYLPAEADIK

SEQ ID NO: 4833 - protein, 61 aa, Streptococcus pneumoniae
LIGGRFPTLPVTTLERIKAKIMETGKNFKKRSTIVGRPLILDQDEGNHTGNPGLKTRENNR

SEQ ID NO: 4834 - protein, 224 aa, Streptococcus pneumoniae
  UNSURE (188): Xaa at each above location is unknown.
EGAQAAMPTALGYVSIGLACGTIGAPYVTPVEMGLMSLFVYAGSAQFAMLALIVVQAPVAAIAMTVFLINLRLFLLSLHASTYFRHTSLWYNIGMSSILTDETYGVLMGELAHTDKVNPMWMHGNNLNSYVAWFVGTVVGTALGGLLPNPEIFGLDFALVGMFIGIFASQFQMMQRRIPVRNLLIILXVVAVSYFLLLTVVSQSLAVLFAMLLGCSMGVVLDGQ

SEQ ID NO: 4835 - protein, 136 aa, Streptococcus pneumoniae; identical to SEQ ID NO: 4068

SEQ ID NO: 4836 - protein, 79 aa, Streptococcus pneumoniae
MKIKEQTRKLAAGCSKHRFEVADRTDEVSSKHCFEVVDRTDEVSSKHRFEVVDRTDEVSNHTYGKVKLTWFEESFEEYK

SEQ ID NO: 4837 - protein, 74 aa, Streptococcus pneumoniae
YETIAKTFIEINFTFPIDLFSSYFNLLYNSPCCGWILFSLLILFETLFKPRQLHLAVGMVTDFVSSIHNLKTVF

SEQ ID NO: 4838 - protein, 409 aa, Streptococcus pneumoniae
VMKVFLQNRDFRQLTINQWISTLGDTIFYLAFLNYVADASFAPLAILLITISETLPQILQIFLGVLADFQHHRVLKYTVISFAKFLLYSIVSLSLSGQSFSLLLVAFICLLNLLSDTLSYFSGAMLTPIFIRIIGQDHLAEAIGFKQSTVSLVKTISNILGGVLLGILSIQFISLLNALTFLIAFLGILFIKTDLLKVEKTISYQEGLSVKSFCQHLLQSSKLIWNMNKVLLVLFIISTSQAVINVTVPISTLFLRNQPFLNLQTGQSLALLSTFELSALIVGSLVSGYLQHTISIKTALYASLVIQLLLLVGFATVRFDWILIFSTLDAFFAGVLSPRLQELVFKQIPEESMGAVQSSIGAITVVLPSLFTIALVTIATSFGTLAVSFVLLLFLLVAFVMLLNIRESI

SEQ ID NO: 4839 - protein, 221 aa, Streptococcus pneumoniae
MKKIISHRYFIIVFLLVIADQKFSVLVLRSDLVAGLSDFAYYLSDMMLNFLVVLFALIAMIWSGKWQKINSRKFKGSYLFYSFLALLAFVAWNFVTFFLFPPTRNEISYQHAAPTFTGATAFLMYFFYPVIAGPIFEDMIYRGLVMTALEKGKKWGLDVLGSAVLFGVSHISNHGWVLTDFVFYMGGGLIFAVLFRMTKSIYWPIGLHIVYNGIGQLLMLL

SEQ ID NO: 4840 - protein, 65 aa, Streptococcus pneumoniae
MLNLQFAETMELTEAELETVYGGEFGNNAVIPAGAWGGLGTSWSITNFWKKYFNHDSSTVNRRHY

SEQ ID NO: 4841 - protein, 295 aa, Streptococcus pneumoniae
MQKLGGGRMIEKMELGEFYKELRLARKLKQTDVACEGLTASQLSKFELGQSMLSADKLILAIQGINVTFDEFGHKLNNYQESPHMRIGRKVVNRFAHQDIAALEQLLEEVDQEQMAQTYRRLNAIVIKDAIHSLNKSYPLAEEDSEFLTTYLYDIESWTWFELYLFCNTMPFLSNQDLIFLSTSLLEKSKEFKELVHNRLYMKQGLLNILSELMERKLFSYIPIFEAELERMLRPYDVFEKVSWQFLKKMSVFLQTKGSNQKEIERFIQSLQVLENPQLTSLFELRFQQYKELID

SEQ ID NO: 4842 - protein, 68 aa, Streptococcus pneumoniae
AFSPNVIPCKIPPVPFFQSSYHLLAFAYYIIICVHLSKHSDTLVIEKASLKLTLKGPSLVQYRTQSSF

SEQ ID NO: 4843 - protein, 205 aa, Streptococcus pneumoniae
LREGCSIYDNLYPSRIVVGDETVEGRKIAELFLSISTHSTANIKNVMLVSPTEAEAIKLFSNTFLALRVAFFNELDSFAERRSLNAEVVIKGVCLDPRIGNFYNNPSFGFGGYCLPKDTKQLKKEFIEINAPVIEAIDISNTNRKQFIVKQILERKPKIVGIYKLGMKYNSDNYKESAILSIINELLIVGIKILVYEPNLNVSYR

SEQ ID NO: 4844 - protein, 251 aa, Streptococcus pneumoniae
MVMSNNTKYIFLSPHLDDAIFSCGDYISKLTSEGEIVLVITIFSGYPLSQQLQPSAKQFHKLCNLGKYPIEERKKEDRLACERLQCDFRHLSYYECLYRKDRNGNFLYRHIYSELKNEDTLKNDIIKELLMHLDDKCVVYCPLSLGDHIDHVFVNSIGRALEFMRYKVIYYEDFPYVSDSSMVSYMGKTKELKMYQEELDEKHYIDRISSILCYKSQILIIWKSVEKLLNNIKELYLRNGAAYSIRFWIKK

SEQ ID NO: 4845 - protein, 73 aa, Streptococcus pneumoniae
KYLILEIKSLSFLSKIVNGLIQNIEENLEDDIERILKYLYICLFNEIFIIKNKVNFFDDVEFNQTLSEFLDKL

SEQ ID NO: 4846 - protein, 114 aa, Streptococcus pneumoniae
TAPQKLDLFCLTFGVQFILHSFGIHPRYPYKMSEIVEMSKKISDLNDKKEFHKKNCELRFQDSVLDNINSVPGTTHLFSCLNIQTLVKIILYIFRYNSCMKIFNFRDKELIFFK

SEQ ID NO: 4847 - protein, 80 aa, Streptococcus pneumoniae
LLPMLRIRNLNNILLRYINFQRILFKNIGEGNMRFYCETYEVITEEKKVSFFYVDEKPLRYLLFDYIFLLVLAKKNIPIL

SEQ ID NO: 4848 - protein, 538 aa, Streptococcus pneumoniae
VYTIIKSNIKKFSLLTIFIVAGQLLLIYAATINALVLNELIAMNLERFLKLSIYQMIVWCGIIFLDWVVKNYQVEVIQEFNLEIRNRVATDISNSTYQEFHSKSSGTYLSWLNNDVQTLNDQAFKQLFLVIKGISGTIFAVVTLNHYHWSLTVATLFSLMIMLLVPKIFASKMREVSLNLTNQNEAFLKSSETILNGFDVLASLNLLYVLPKKIKEAGILLKMVIQRKTTVETLAGAISFFLNIFFQISLVFLTGYLAIKGIVKIGTIEAIGALTGVIFTALGELGGQLSSIIGTKPIFLKLYSINPIESNKMNDIEPNEVNRDFPLYEAKNICYKYGDKEILKNLNFCFQRNEKYLILGESGSGKSTLLKLLNGFLRDYSGELRFCGDDIKKTSYLNMVSNVLYVDQKAYLFEGTIRDNILLEENYTDEEILQSLEQVGLSVKDFPNNILDYYVGDDGRLLSGGQKQKITLARGLIRNKKIVLIDEGTSAIDRRTSLAIERKILDREDLTVIIVTHAPHPELKQYFTKIYQFPKDFI

SEQ ID NO: 4849 - protein, 317 aa, Streptococcus pneumoniae
MDRNIDQELVSIIIPTHNRYESLIRAVKSCLHQSYKNIEVIIIDDNYSNVNLRNKIIHQFGYTNHRIKLILSNEDLGATNARNIGIKNSRGKYISFLDDDDEYMPDRILKLMACFKKSRMKNLALVYSYGIIIYPNGTREEEKTDFVGNPLFVQMVHNIAGTSFWLCKKEVLELINGFEKIDSHQDGVVLLKLLAQGYQIDIVREFLVNYYAHSKENGITGVTQKTINADEEYYNYCRKYFNLLSFNERILVTKKYYSLNIKRLLLIGDKCKALKVIKKAREEKIFNEFLFLKYMLLYNFGFFYCIYDNYVQLKFRK

SEQ ID NO: 4850 - protein, 174 aa, Streptococcus pneumoniae
LDPEKRPDRFLEFAEKLFLVREDVIFIMAGNGSMWAALKEKICHLKCRDNFRLLGEIYPATIVYQISDLLYIPYDTEGIPMCVLESMSQGTPVLASNVGGLSEIIEHRVDGFLFEKEDVEGVCACANFLLNDSEYLKYIGENSKSKIRKHFSVQKMFVETMRVYDELLEKSSHG

SEQ ID NO: 4851 - protein, 187 aa, Streptococcus pneumoniae
MVTMQYSCGKININIPDGYGDIKDIVFSAHIIVRYNNGHCGGIDPHIIGLCKKQIRRMSLYPILIIVSRDSKVIDDYKNLDIAYVDCTQCSNNFETALHVKNILKLLKIRLIHCHGYSTNYFLYMLKKLDKNGFGKVKTVITCHGWVEYNLKKKFLTYFDFWTYSMGDAFICVSETMKKRLESIIKK

SEQ ID NO: 4852 - protein, 106 aa, Streptococcus pneumoniae
KIDRDKLKIYIETHPDAYLTEIAAEFNCPPTTIHYALKAMGYSLKKSRTYCEQDPEKVNRFLKELNHLSYLTPIYIYETGVETYFYLEYDRALSRQLVSLKEDIII

SEQ ID NO: 4853 - protein, 87 aa, Streptococcus pneumoniae
MAPMTYKDTMTSDFFEACFQKFLLPTLDTPSLIIMDNARFHRMNMCKEQGIDCYHFLPIHLSIIPLRKYGLTSKTSQNNIVKLRCFS

SEQ ID NO: 4854 - protein, 354 aa, Streptococcus pneumoniae
LECFGSIISVVGNPTPGIIGSFLVEKKPHMTYNEKRLTNSLERVHMEQLKNTTDLLGLEDKNIKILSVLKYQTHLVVQPKLDSPAPPCPHCQGKMIKYDFQKASKIPLLDCQGLPTVLHLKKRRFQCKNCLKVVVSQTSIVKKNCQISNMVRQKIAQLLLEKQSMTEIAHRLAVSTSTVIRKLREFKFETDWTKLPKVMSWDEYSFKKSKMSFIAQDFESKSILAILDGRTHAVIRNHFQRYQREVRELVEVITMDMYSPYYRLAKQLFPKAKIVLDRFHIVQHLSRAMNRVRIQIMNQFDRKSLEYRALKRFWNPRFFVSRLGLNQSTGLIYYTRIASSSVRNDSISPRFECT

SEQ ID NO: 4855 - protein, 128 aa, Streptococcus pneumoniae
MHLTHREVRDKLLSYSEGLQVHYELYQLLLFHFQEKNADHFFGLIEQELPTVHPLFQTVFWTFLRDRDKIINALKLPYSNAKLEATNNLIKVIKCKAFGFRNFNNFKKRILMTLNIKKESTNFVLSRL

SEQ ID NO: 4856 - protein, 70 aa, Streptococcus pneumoniae
WVGEKLQSGEYEIRTLFFDVQSHQNPFFKIVKVPETKGFALDNLNQIIGRFKFSVGIRQLKCVDNLISIP

SEQ ID NO: 4857 - protein, 336 aa, Streptococcus pneumoniae
MKDRYILAFETSCDETSVAVLKNDDELLSNVIASQIESHKRFGGVVPEVASRHHVEVITACIEEALAEAGITEEDVTAVAVTYGPGLVGALLVGLSAAKAFAWAHGLPLIPVNHMAGHLMAAQSVEPLEFPLLALLVSGGHTELVYVSEAGDYKIVGETRDDAVGEAYDKVGRVMGLTYPAGREIDELAHQGQDIYDFPRAMIKEDNLEFSFSGLKSAFINLHHNAEQKGESLSTEDLCASFQAAVMDILMAKTKKALEEYPVKTLVVAGGVAANKGLRERLAAEITDVKVIIPPLRLCGDNAGMIAYASVSEWNKENFAGWDLNAKPSLAFDTME

SEQ ID NO: 4858 - protein, 145 aa, Streptococcus pneumoniae
MIEIKRIQQQPDLAQAIYAVMAAVYLVSPWTLEQIQADLSQDQTWYALAYDGAEVIGFLAVQENLFEAEVLQIAVKGAYQGQGIASALFAQLPTDKEIFLEVRKSNQRAQAFYKKEKMAVIADRKAYYHDPVEDAIIMKREIDEG

SEQ ID NO: 4859 - protein, 227 aa, Streptococcus pneumoniae
MKVLAFDTSSKALSLAILEDKQVLAETTINIKKNHSITLMPAIDFLMESLDWTPKDLDRIVVAEGPGSYTGLRIAVATAKTLTHTLNIELVGMSSLLALVPYQQEGLFVPLMDARRNNVYAGFYENAKPVMPEAHLSFEEVLEKVKGASQVTFVGEVAPFVEQIQEHLPRTNYKETLPNAANLALLAWDKEADSLHDFVPNYLKRVEAEENWLKNHTESGESYIKRL

SEQ ID NO: 4860 - protein, 61 aa, Streptococcus pneumoniae
MTNFDILDNQFLSLSENELSDIDGGLAPLVIFGVAVSWKAIAGGTALIGSGLAAGYFLGGD

SEQ ID NO: 4861 - protein, 76 aa, Streptococcus pneumoniae
LEGYCRWNSTYRFWFGSWLFFRRRLTMMKDLNNYREISNKELQEIKGGFGVGVGIALFMAGYTIGKDLRKKFGKSC

SEQ ID NO: 4862 - protein, 77 aa, Streptococcus pneumoniae
MIYKVFYQETKERSPRRETTRALYLDIDTSSELEGRITARQLVEENRPEYNIEYIELLSDKLLDYEKETGAFEITEF

SEQ ID NO: 4863 - protein, 559 aa, Streptococcus pneumoniae
MAYTLKPEEVGVFAIGGLGEIGKNTYGIEYQDEIIIVDAGIKFPEDDLLGIDYVIPDYSYIVDNIDRVKAVLITHGHEDHIGGIPFLLKQANVPIYAGPLALALIRGKLEEHGLLRNAKLYEINHNTELTFKNLKATFFRTTHSIPEPLGIVIHTPQGKIVCTGDFKFDFTPVGEPADLHRMAALGEEGVLCLLSDSTNAEVPTFTNSEKVVGQSIMKIIQGIEGRIIFASFASNIFRLQQATEAAVKTGRKIAVFGRSMEKAIVNGIDLGYIKAPKGTFIEPNEIKDYPAGEVLILCTGSQGEPMAALSRIANGTHRQVQLQPGDTVIFSSSPIPGNTTSVNKLINIISEAGVEVIHGKVNNIHTSGHGGQQEQKLMLCLIKPKYFMPVHGEYRMQKVHAGLAVDTGVEKDNIFIMSNGDVLALTADSARIAGHFNAQDIYVDGNRIGEIGAAVLKDRRDLSEDGVVLAVATVDFKSQMILSGPDILSRGFVYMRESGDLIRQSQRILFNAIRIALKNKDASVQSVNGAIVNAIRPFLYENTEREPIIIPMILTPDEE

SEQ ID NO: 4864 - protein, 120 aa, Streptococcus pneumoniae
LSFNLKRKHREKQLRRRGCFVALFFIWCEDHRDDDRFTFGIFIEEGANSVDNGTIDRLHASILIFQCDTNGIEEDTLALANQVSRLSHVDKASAEDIWARQNHLRFEVNSCDCQNDTVFR

SEQ ID NO: 4865 - protein, 637 aa, Streptococcus pneumoniae
MIYHFTEEYDIIVIGAGHAGVEASLAASRMGCKVLLATINIEMLAFMPCNPSIGGSAKGIVVREVDALGGEMAKTIDKTYIQMKMLNTGKGPAVRALRAQADKELYSKEMRKTVENQENLTLRQTMIDEILVEDGKAVGVRTATHQEYAAKAVIVTTGTALRGEIIIGDLKYSSGPNHSLASINLADNLKELGLEIGRFKTGTPPRVKASSINYDVTEIQPGDEVPNHFSYTSRDEDYVKDQVPCWLTYTNGTSHEIIQNNLHRAPMFTGVVKGVGPRYCPSIEDKIVRFADKERHQLFLEPEGRNTEEVYVQGLSTSLPEDVQRDLVHSIKGLENAEMMRTGYAIEYDMVLPHQLRATLETKKISGLFTAGQTNGTSGYEEAAGQGIIAGINAALKIQGKPELILKRSDGYIGVMIDDLVTKGTIEPYRLLTSRAEYRLILRHDNADMRLTEMGREIGLVDDERWARFEIKKNQFDNEMKRLDSIKLKPVKETNAKVEEMGFKPLTDAVTAKEFLRRPEVSYQDVVAFIGPAAEELDDKIIELIETEIKYEGYISKAMDQVAKMKRMEEKRIPANIDWDDIDSIATEARQKFKLINPETIGQASRISGVNPADISILMVYLEGKNRSISKTLQKSK

SEQ ID NO: 4866 - protein, 157 aa, Streptococcus pneumoniae
LMGGCTHTDSLAIFHQNLINHGLTKGQIFLIFNCLAHLLRVKFLVSLRTKSTDSWPLPCVEHLHLDVSLVNSLGHLATEGIDFTYDNPLGRTTDRGITRHESQHFNIDGRKQDLTAHTASGQGSLNPSVSRTNYNNIVFFSKMINHVSLLFLKMNVS

SEQ ID NO: 4867 - protein, 160 aa, Streptococcus pneumoniae
LCRLRERTRMTQQDFRTKVDNTVFGVRATALILQNRKLLVTKDKGKYYIIGGAIQVNEKTEDAVVREVKEELGVKSQAGQLAFVVENRFEVDGVSYHNIEFHYLVDLLEDAPLTMQEDEKRQPCEWIDLDKLQNIQLVPAFLKTALPDWEGQLRHIHLEE

SEQ ID NO: 4868 - protein, 391 aa, Streptococcus pneumoniae
VKHTRPSIVNKRIDGRLTMSDNSKTRVVVGMSGGVDSSVTALLLKEQGYDVIGIFMKNWDDTDENGVCTATEDYKDVVAVADQIGIPYYSVNFEKEYWDRVFEYFLAEYRAGRTPNPDVMCNKEIKFKAFLDYAMTLGADYVATGHYARVARDEDGTVHMLRGVDNGKDQTYFLSQLSQEQLQKTMFPLGHLEKPEVRKLAEEAGLSTAKKKDSTGICFIGEKNFKNFLSNYLPAQPGRMMTVDGRDMGEHAGLMYYTIGQRGGLGIGGQHGGDNAPWFVVGKDLSKNILYVGQGFYHDSLMSTSLEASQVHFTREMPEEFTLECTAKFRYRQPDSKVTVHVKGDKAEVIFAEPQRAITPGQAVVFYDGEECLGGGLIDNAYRDGQVCQYI

SEQ ID NO: 4869 - protein, 59 aa, Streptococcus pneumoniae
LSKRAVTDESTPPLIPTTTRVLELSLMVSLPSIRLFTIEGRVCFTIEGRLSSIHYNTLG

SEQ ID NO: 4870 - protein, 65 aa, Streptococcus pneumoniae
IDLCSYSLGTYLMISGNVIKKRLLFSNLKNRLEKMGCFIYYSYLNEDKNKVYSHHSHNLYIDYKF

SEQ ID NO: 4871 - protein, 550 aa, Streptococcus pneumoniae
GESERSKKSFGREQAANLKYQQELVKYIKYTRENNSTKRTEAEKVMTAAKKEHEKKQTELAKVLAKVIPSAEELENTRQKAEKAKEKEPELTKKLEEAKAKSEEAEKKATEAKQKVDAEHAEEVVPQAKIAELENEVQKLEKDLKEIDESDSEDYVKEGLRAPLQSELDAKQAKLSKLEELSDKIDELDAEIAKLEKNVEDFKNSNGEQAEQYRAAAEEDLAAKQAELEKTEADLKKAVNEPEKPAPAPETPAPEAPAEQPKPAPAPQPAPAPKPEKPAEQPKAEKPADQQAEEDYDRRSEEEYNRLTQQQPPKAEKPAPAPQPEQPAPAPKTGWKQENGMWYFYNTDGSMATGWLQNNGSWYYLNSNGAMATGWLQNNGSWYYLNANGAMATGWLQNNGSWYYLNSNGAMATGWLQYNGSWYYLNASGAMATGWAKVNGSWYYLNANGSMATGWLQYNGSWYYLNANGAMATGWAKVNGSWYYLNANGSMATGWVKDGDTWYYLEASGAMKASQWFKVSDKWYYVNGLGALAVNTTVDGYEVNANGEWV

SEQ ID NO: 4872 - protein, 78 aa, Streptococcus pneumoniae
KKLKLTLRKQLMSQKNQLQLQKLQPQKHQLNNQNQRRLLNQLPHQNQRSQLNNQKQKNQLINKLKKTMIVDQKKNITA

SEQ ID NO: 4873 - protein, 63 aa, Streptococcus pneumoniae
LLISWFFCFWLFSWLLWFWCGSWLRSRRWFWLFSWCFWGWSFWSWSWFFWLINCFLKVSFSFF

SEQ ID NO: 4874 - protein, 102 aa, Streptococcus pneumoniae
GAGAGFGCSAGASGAGVSGAGAGFSGSLTAFLRSASVFSNSACLAAKSSSAAARYCSACSPFEFLKSSTFFSSFAISASNSSILSLNSSSFDSLACLASNSD

SEQ ID NO: 4875 - protein, 105 aa, Streptococcus pneumoniae
GTTSSACSASTFCLASVAFFSASSDFALASSSFLVSSGSFSLAFSAFCLVFSNSSALGITFARTLASSVCFFSCSFLAAVITFSASVLFVELFSRVYLIYLTNSC

SEQ ID NO: 4876 - protein, 102 aa, Streptococcus pneumoniae
MNKKKMILTSLASVAILGAGFVTSQPTVVRAEESPVASQSKAEKDYDAAVKNATAAKKAAEDAQRALDEAKAAQKKYDEDQKKTEEKAKEVKKASEENKLQI

SEQ ID NO: 4877 - protein, 92 aa, Streptococcus pneumoniae
MYNDVIERISLYEFIGDIFYSKIISCCIVASDLSKNTMKLDVIFFEDKNKRSAVLGLRRDKSGVFKPVTLHFTSAKKYAKVRKTDVKEMKWL

SEQ ID NO: 4878 - protein, 99 aa, Streptococcus pneumoniae
LGNSENCPVLFYFEKIWSLSLKLLDCILDYQERFNGKTCQVSTNYKYLEIFKVNFCLTDLHHLFDLYKITRDYASQTKPAIQAGVFILEDFRNILCTMM

SEQ ID NO: 4879 - protein, 70 aa, Streptococcus pneumoniae
MENRHMKHFFAGIGEIKLVGYLLYICVGLAPLFHIYVIGSELSFVKIVLSILGVIFVSMLTIARIYRTFL

SEQ ID NO: 4880 - protein, 252 aa, Streptococcus pneumoniae
LGWIHICDSKMSNVDKIRKIHIIVCWMYIFLSFRAIINDTEYFLLIFLAFIYSIVSLPLYSVKNKIVSICLAINSILLMSFPILINKFFPESFLTYTVLISVFILELAIFHLIGEDFATKLTNEYKKISQFRSKVSQSPWIKYLEISSFILTIFPSILYGTVDNHVLTLIFLIKICADTTIKFLFIRLFDTSTLMKRRIFFLFALDVIVYLFLGYLLVIQKAGYLFSVLLLFSNFSVPFIKEKEYELFKNSK

SEQ ID NO: 4881 - protein, 128 aa, Streptococcus pneumoniae
MKQFQLRRRKQMELVLPNNYVVIDEEEMMYLDGGAYLSKRACQGICVALAMSSGTFIALAGAAVLTKKLINYIKVGSFGGWLIGAAAGVLAGAAGRIAYCIGYGTLNRDCDISGNPYPWDGFISATVR

SEQ ID NO: 4882 - protein, 300 aa, Streptococcus pneumoniae
MIRKLIVFLLMLPLFVLWLELHVLVNNLLLNLESPLDFVISMSLAFCSLILSKIVLDILYALKDLYKKEALITIFPFIFIGRKKVNVRFSPYFSFHRKSLSPDDLRSRIIWSFILEIAIILVFILKIPFAIIMLTTIFFWTIMDINHLVFNKTEFLFNQNKWEKEDSFESDLTKTLKDKIQKSELSYSDLMSLLLYDAMNQSTFLTDSELFEDILKKIEDSHNTLLCTGFVELLLYEMSISNNNNWSNKVDKIRIHLIRINQLDFFYYTSWLRQNFDFCMNREYHKMKSRKLLLSNKKIV

SEQ ID NO: 4883 - protein, 60 aa, Streptococcus pneumoniae
MGIKMEKIFVIIFFVCLFISSITFLAYDFVSEEIKKLIIWINVVFLILIIAMMIYPKLRK

SEQ ID NO: 4884 - protein, 124 aa, Streptococcus pneumoniae
MELVLPNNYVVLEQEEMMYLDGGFSIPRWPVATAINIAFNGVLGGGAISLVRNYIRNYGLRRVTSAIAGAAARYVGVRVANRVAGFALSAINGFAAWMSIGDAITTIWANNDVNRRDPNLNALW

SEQ ID NO: 4885 - protein, 61 aa, Streptococcus pneumoniae
IRYPFSTLFVFIGYLRFKINYCLKLNSSKPLAINDCELTNTISKFIFFDLVTQFQLAIHLI

SEQ ID NO: 4886 - protein, 226 aa, Streptococcus pneumoniae
MGFSPGIAVFYKESQTTKNLFKFYYFLYFTTLISYYFFFTFVYDKPLLLPLIPFSIIIALVQKLYRIENQQLFLLKSKVLTILESKKNCEFNLQDYHEIWKLQSKSELPCVALSYISLIKPYLSESVREQIDLLEVKRFKKINHPISLYGMLDVIKLNLYLRHYNEKNKYESMLKKILEVRPDFVLIEQNIDDSLNSSQPLSLSLAISEIQLLLEVYMGIKHVSTK

SEQ ID NO: 4887 - protein, 75 aa, Streptococcus pneumoniae
MFLHHFTEIYDTFAPFLPLLSKQKNRKPEPAVKEQFRKFPFYLFNCNQAIWLYCELWLVCHATVWFEVVPACSVR

SEQ ID NO: 4888 - protein, 318 aa, Streptococcus pneumoniae
MDIDRNRLRTGLPQVGVQPYRQVHAHSTGNRNSTVQNEADYHWRKDPELGFFSHVVGNGRIMQVGPVNNGSWDVGGGWNAETYAAVELIESHSTKEEFMADYRLYIELLRNLADEAGLPKTLDTDDLAGIKTHEYCTNNQPNNHSDHVDPYPYLASWGISREQFKQDIENGLSAATGWQKNGTGYWYVHSDGFYPKDKFEKINGTWYYFDGSGYMLSDRWKKHTDGNWYWFDNSGEMATGWKKIAEKWYYFDVEGAMKTGWVKYKDTWYYLDAKEGAMVSNAFIQSADGTGWYYLKPDGSMADKPEFTVEPDGLITVK

SEQ ID NO: 4889 - protein, 110 aa, Streptococcus pneumoniae
MQQITEIIIAFATSFLTVAVGGIVKAVKDYLLRKGGEKAVIIAEILAKNAVNAVEQVAAETGYKGDEKLAQARAKVRAELTKYNISMTDKDLDTFVESAVKQMNDAWKGR

SEQ ID NO: 4890 - protein, 138 aa, Streptococcus pneumoniae
MQIEFFNFLRSVVQTEDGLVLYALALIVSMEIIDFVTGTIAAIINPDIEYKSKIGINGLLRKISGVLLLMILIPASVLLPEKTGFVFLHSIYLGYIAFTFQSLIENYRKLKGNVTLFQPIVKVFQRLLEKDDDTKKGE

SEQ ID NO: 4891 - protein, 116 aa, Streptococcus pneumoniae
MAETNQNTDNLLDLTKITEPFELASALRYMKENGEFIRCKNVSDDFYMYRDVQKRPVIVNGRRQFKDVETVWAFNQWGGTIATINVAVLLNHEFYIMKFDAEGNPDWTVPTVEPKE

SEQ ID NO: 4892 - protein, 67 aa, Streptococcus pneumoniae
MNTEQLNQALQMTISEMSTTSTNSMITSNILSIQLNEQREENQRLQARVDELEALLDEQTKPADKGE

SEQ ID NO: 4893 - protein, 2119 aa, Streptococcus pneumoniae
MDALTRRQFDRAMFAKERTLAIRVGEYASRDIKEASFEYGYIKGDTYKPGGTCAGSGKITFTSIITTFNKLDTLHPEIGLLVGDTYQWVKMGEYFINDIEIDRNRNTTTLELMDGMFKLNREYVTDLHFPAEVREVIQEICLKTGIELANDYFGISAMRYHIEQVPEGKKLSFRDMLSAMTQMIGMSCFFNREGKMEIRDLTESNITINADSYFLHGLTKSEIEYQIAGITCKTDKKSLTVGMTTGRSLELDNVFITQSALNDLYYKLKNLTYYPYNLNYQGHLLLEVGQWVTIQTNKKETFKVPVLSQSFIFKGGLRGRISADSKAGNDTQYSYEGTITKQIKQQDGFEAKIQAQIEAADKDFDQKVDKIKKDFNDQVELAKARAEEVKRELSDTINQRFNSFDNGPLKEAKRKAEEALRNAGASSSLAQESKRIGLDSVARLEAFKSQTTSAQTALSGDLDVLKRTIANDIRPKQAQAEAEIAKQVEALSRTKNELDGASTLLAQEAKRIELDSVARLEAFKSQTTSAQTALSGDLDVLKRTIANDIRPKQAQAEAEIAKQVEALSRTKNELAGVKSAQATYEETTTRRLSELTNLANGKASKSELTQTAEELASRIASVQAGSSRNYFRNSRSRTFTTGGQAVYDYRTFIVPDFWKNSDRFKRDYVRISFDVTFPVALVNDMPAMVHFSAHPWYAYRNLIFKGGTVERQHFEFTIDLSSSSETYQTNNVFIRFGTNYGFPAGLQVVIENAMLSVGNYFPAYQPAYEDQDERVSAVESNFKQRADSLDAGVSRLTEGLRTKVDISSLNVTAENIRQSVKSLETDTQNKLNQKLSQAEFEVRAGSIRQEILNATKDKASKSELTQTAEELASKIASVHLGRRNLLKGTKELARYKPVSEYNGFKVIRTVAGATRYQDSYVERTVIPTAGTEYIAIFYARASENDYPVRCHFYNPNTVVSSENSSGYKSRSSDGLSIIRLSTDWQLCWVKWTQTATDQAKTVIIGRHGPQVGGKEGVWVEICAPAIFEGNLAGDWSPAYEDQDERVSVVESNFKQRADSLDAGVSRLTEGLRTKADISSLNVTAENIRQSVKSLETDTQNKLNQKLSQAEFEVRAGSIRQEILNATKDKADKTLVVTEAGKLREEFSKMKVGGRNLWIKSKTVGAVIEKLPENHVTGQKECYRLENNSTLTFNLEPDFSSRLYQKVTFSAWIKYENVVQGRNFWNVFNCFKHYLFRKNSETGVQSGPDYATLGMYKGSADWKYITFTYDYSEKTNFDQLKTSLRFNLEGATSGTAWVTGIKVEIGSVATDWNPAPEDADGLITEAKATFERTAQGLRTDLSAIQEYVNKDGQRQEALQRYTREESARQATAVRELVNRDFVGKATYQEDVKGINQRIEAVKTSANKDIASQIASYRQSVDGKFTDISSQITTYKQDVGGQISGLSNRLTSSEQGTTTQISNLSNRINSNKQGTDNQISNLKTQVATNKDNAERQMGRISDQVSANKANADSQFANVTNQLARKVETTDFQRVKETSKLYERILGNTENGIADKVARMALTNQLFQVEVGKYSVSGPNLIKNSDFKNATNEWGSTQNLGRLVKHSFYHNGQKDLMRLSNATKNENFLYSHRFNLERNTDYVLNFRGFNNSALASYDVYILGRRAGESDGFTIVKKVVSSKKLSTSRCEDVSVTFNSGEMDNAYIRFDNNGSSSGTADLYITEVDLYKGYKPRTWQPHPEDAVADANKKLEATQTKMTQLAGSWVVENINSAGDIISGINLGANGHNRLVGKLTHITGETLIDRAVIKSAMVDKLKTANFEAGSVTTTILEAEAVTAEKLKVDNALIKKLTATDAFIDQLISKRIFSTKVESVISSSTFLEAYQGRIGGFTLGQFDQGGGRWISGVNQFSVGMGNGAGYGVRTAFWANWGNNWNYAGPKAWNVNTDGKMYCRNEVGFYDQVDFSNSSRANFYGNTTFSRSPVFSNGIELGSKDVLGDGWNPKGGRNAVVWWNQVGSGSLKYWMEQKSDRRLKENITDTAVKALDKINRLRMVAFDFIENKKHEEIGLIAQEAETIVPKIVSRDPENPDGYLHIDYTALVPYLIKAIQELNQKIEKMEKTIA

SEQ ID NO: 4894 - protein, 78 aa, Streptococcus pneumoniae
LIKICFFRVVISECNIFPICRTFIHTKRSIIWTTLYSGLTIFSKKIMFEAIKYIPKISTLDYIFVLDPSAKSNFLVQP

SEQ ID NO: 4895 - protein, 116 aa, Streptococcus pneumoniae
MAQLTINGVAVKPPKSFQVGIQDIDGETGRNANGDMVRDRITTKRKLDCEWGMMTQGEISQLLHAVSSKFFEVSYPDPMDGQVTKTFYVGDRTAPSYTFTEKLKPWSGAKFNLVER

SEQ ID NO: 4896 - protein, 1217 aa, Streptococcus pneumoniae
MATLDELKVMIDAEIAPFRKKMKEVENQVKGTSDQVKNATAKVREQSSSIGSAFGKLAKFAGFAILGKKLLDVGMYSTQTALEVSASMNQIKRQMGESSQSFLKWVNDNANAMNMGVGEATNYGAVYSNLFSGFIKDTNKLSAYTAKMLQTSAVVAEGSGRTITDVMERIRSGLLGNTEAIEDLGINVNVAMIESTEAFKKFANGQSWQQLDYQTQQQIRLMAILEQATAKYGDTLSNSVNGRISLFKSLMKDAALNLGNSMLPIINAIMPVLNSFAMVLKNVTAKLAEFIALMFNKKATVKDGVGGAVGDMGNAMKDAAGGAGDLADAVDDAGDSAGGLADNLGDSAKNAKKAAKELLGLLGFDEINILQKPKDDDAGGSGGGGKGGKGKGGGGGPFKDILPEVELTDMDNKFKSIFDGLGDKLKGLFDLFKKGFDAAFRPEGIERIKTALDQIAKTMGEIATDPRVVNAFNRMAEKIAYALGQVTGSITTIGLGIGVFLAESIANGLGRQKERITRALVALFDNIGNISEAVGNIAQDFSSTFYDVITSTGAVRIGSAIVSTLLSLTSTIVEVGSKLAGSLFKGFEKVVVTSAPKISSVFQSLLDTVAPVFESIERSVNKFGDGLSRVYDEHVAPAINSIANAFNGLIDIIQILWENSWQPFAEFLSGVFGVSIEGISDLLGGGLLATLGLLADAIKLVADGFTVFSDWCKENKEPILALITTWQTINFLSWAEQAGGLAGAFSLLGSKVSLIVGGIKNLGLAIKALTFDKLVSFGETIYLNTLYAKDFVVNSGKTIAQLGKTALELGKSALAWTAHAAKMGLATAAEFAHSVAAGVATAATWAFNAALAVLTSPITWIIAAIAALIAIGVLLYQNWDTVVEFAKTAWQGLCDFISGICRAIGEFFSGLWTKLQEIFEPIGQWFGEKFQQAWDAIVNIFSGIGEWFSGVFQGAWDAIVNIFTPIGSWFGQRWADVTSALANIGAWFTDIFQKAWTGLTNIFSKLGLWFGERWADVTSVLANVSSWFGNMFTSAYNAVKNAFSSIGGFFSGVWSTVQSIFVNAGQKVGSAVGGAFKSAVNAVLGTIENVVNDFIGMINGVLGVVRNLPGLGWVGSVSTVSLPRLARGGIVDSPTIAMIGEAGKEAVVPLENTGFIQTLGRVVSSAVVNAMAGISPQGGFSSDGDIVIQIAGHEFGRVAIQEINKEHERAGQTLLKI

SEQ ID NO: 4897 - protein, 186 aa, Streptococcus pneumoniae
LKGPPPPPFPLPPLPPPPDPPASSSFGFCKMLISSNPKRPSNSLAAFLAFLAESPRLSASPPAESPASSTASARSPAPPAASFMALPMSPTAPPTPSFTVAFLLNIKAINSASLAVTFFKTIAKEFKTGIMALIIGNIELPRFNAASFISDLNRLIRPFTELDKVSPYLAVACSRIAIRRICCWVW

SEQ ID NO: 4898 - protein, 69 aa, Streptococcus pneumoniae
MISNHVSLLLSKDAKAFEFWEYAPELFVEEQQAVEQERQKQALLLHKERMREFAERHNRKRKEEVNGNS

SEQ ID NO: 4899 - protein, 72 aa, Streptococcus pneumoniae
SIGFYSTRKQGQENFQEENDSRQVILTVTQIIERLYPMFLDIEGKPLDFWDLTVLEIREMIESYNRVKIQER

SEQ ID NO: 4900 - protein, 126 aa, Streptococcus pneumoniae
MALKYTTWKVTDEKELKLRLTSHQTATVEEKIGMNLLKIFMPEAGEEFTLPPLKVMLLLVHGALQQYEHGYSLEDVYDLYDEYVDNGGDQTTFMTEVLMPLFEVSGFTPRGSKDKKTSKKKMTVDK

SEQ ID NO: 4901 - protein, 137 aa, Streptococcus pneumoniae
MLANGITLSYGETKDSYTKLVGLKEVPEFGIELEKVENTTLEDTVKKYEFGIGDIGELEYKFSYNNSSATAPYRVLRKAADDKKKLYFEQAYPDGTKVIFEGQVSVKLGGGGVNAVIDFTLKIALQSNLTFTDGIGG

SEQ ID NO: 4902 - protein, 122 aa, Streptococcus pneumoniae
MINIKPVIYKELQKVADNVTDTYPSDWETFPVVIFLEEQNKPGDWFDDQEQKSSIRYKVDIFDDTSTSELAVKINQIFESLGLRRTDCQDVPDPSHLRHKVMRFEGIVDLHSELVFQFRMEN

SEQ ID NO: 4903 - protein, 171 aa, Streptococcus pneumoniae
VSGLLGADRLIAKCRRLASKKTGEDIVLRAVHNATIKVVQADARRLAPARDGELITSIKTRAKMDGDKAIGEVYTNLKYAPYVEFGTGPIGQASHSGISPEVSVTYKSSPWYVHEDQINVGPYHFQKIGEFYKMYGQPAQPYLYPALRDNQERVSKNISNYVRRKIREQIK

SEQ ID NO: 4904 - protein, 60 aa, Streptococcus pneumoniae
LILVISSPSLAGASLLASAWTTFIVALCTARKTISSPVFLLANRLHLAISLSAPSSPDTL

SEQ ID NO: 4905 - protein, 112 aa, Streptococcus pneumoniae
MFLKQSRLKPYPMRRFEKTVTEEGVAKEGYAKEAETVRLELWPASSKLQSELYGERVNDILNANANKSATIKVKDGVCIDSQTEVTHRVISKKVYTHHQVLELERVRATRGR

SEQ ID NO: 4906 - protein, 103 aa, Streptococcus pneumoniae
MSIELLKKLTGEEDTQLLMLLQTRATNLILSETNRTSLTPALSLLIPEVAIELHNRSGAEGEHSRTEGGIAVVYGENGLSTDLLQRIRMHRLARVAGHVFEAE

SEQ ID NO: 4907 - protein, 62 aa, Streptococcus pneumoniae
VKFKIKQDFYDWESNVKRLAGEELEITEERYAELADNIASNGVTISDVLEKILPEPEFLEED

SEQ ID NO: 4908 - protein, 60 aa, Streptococcus pneumoniae
MSLLLRRHYIQEEQVNQYSDLENKTLEELKDLAKEAGVAGAYKLTKAEIVEVLEELKSEI

SEQ ID NO: 4909 - protein, 281 aa, Streptococcus pneumoniae
MTAGQTKLATMVNPEVMADMVAAKLPKLIKFTPLAYVETKLEGQPGSTLTVPAWEYAGDATEIEEGQAITPDQLTTKKTTMTIKKAGKGYEITDESLLSGLGDPLGQATYQLGLAIANKIDNDLVAVAKTATQHITETPTTLEAIDKALDIFEDEEDAQYVAIINPKDATKLKTAVAKEWIKGSELGANMVVSGTFGEVDGVQIVRSKKVDEGKGFLVKVSPSQTQTDDANKYGAFVILLKRDVAIETDRDILKKTTVITGDEHYGVYLYDPTRVVKFGGA

SEQ ID NO: 4910 - protein, 194 aa, Streptococcus pneumoniae
MSEEINATVSTESTETVDTQGNVDSVQEEKHERTFTRAEIGKMLSAERSKWEAEQEAKENEAKKLAKMNADEKQKYQLDQREQELADREKAIARKELTAEAKAMLSERDLPVELVNVVDLTSAETVSQSVAVLQKSWEQAVQKGVQEKLKGGAPMKQAPVDSDGITKEEFARMGYQSRNELYQKNPELYKKLKG

SEQ ID NO: 4911 - protein, 85 aa, Streptococcus pneumoniae
LRYYPYRSLKERNRKMEEWKERFKKEYYELKERFQKLDMMIGKYEKGQLEFESKCPIDSLKGQRSTMWNYLRILEQRAKIEEIKL

SEQ ID NO: 4912 - protein, 75 aa, Streptococcus pneumoniae
MAILDDLQALYDNGWDASFNYNGQVCGIFPNSIYDVVVIIADDEYRASSFDDLISLQIEGKTLPEIMNEVEVQYG

SEQ ID NO: 4913 - protein, 467 aa, Streptococcus pneumoniae
MKNQEYWAKRKANLIYQQMDKAEKQADQFDKVYQEAKTYLDKEINKIFDKFQRDYGLSQVEARQVLKNMKDKKNLNELRKVLEARPNDPNIQRLLADLDSPAYSFRMKRLERLSDDLDRMRESIYHSEKTGSDAFYSDLMKDSYYKATFDLQQQTGLAYGFSGLPENEIKHLQSFSWVGDGSTYSTDIWKNTGKLTSSIKDELLISLMTGRDTRETAQAIAERFNVGQNDARRLVRTESAFFHNQMELLSYEEADIEKYIFVAVLDKRTSRICQEHDNQVYDRDKAVPGVNCPPMHPWCRSTTVGYDEDADYSKLKRRARNPETGKVEYVPADMTYKEWYSKYVDGNRESIKRKAFDKTIKDGIIVSVSGTTIGHTPPGKIGLPNSVVQHNATNGDVLGRTYYDARGFKTKDVHFTNHKQPARHPYGKIGEHAHDFVFDDEGKFVSRSTRELTDDERKENQDILWRY

SEQ ID NO: 4914 - protein, 489 aa, Streptococcus pneumoniae
MYQYLTYPRDGYDEGSLKKDLIYKLITIHNTESSRLKNLKSYYMGDHAILNHKRRNVNAPNYKTVANHAKDIADTATGYFMGNPIKYNNTADGDIDELLTAFDGAEIDQVDAQNALNMAIYGRAYEYIYAKEGMTELDSTSIDPENTFMVYDDSIERKPLFAVYYYEVKDDTKDTTKHQAEVFTENLHYHMVLRSTDSGTTQSEEATPHNLGQIPIIEYRNNHFAIGDYEQQISLIDAYNSLMGNRVNDKEQAVESILVLYGTQLADTPEDAKVAMKILSEEGLLELPGDSARAEFLKNTLDESATEILRTALKEDIYTFSHVPNLTDENFAGNTSGVAMEFKLMGLEMITKTKEANYKRGLRQRIAIFAHYLGMKQIALESHSIVPQFSRGLPKNLLEISQIVNNLEGKVTNRQLISLLPFVEDPDAELEALEEEKKKNMEDMPMFNKDNTKPEDEVEDEESGVLGEEESQSDLPADGQGRKAGRPVR

SEQ ID NO: 4915 - protein, 432 aa, Streptococcus pneumoniae
MSQTYQIKQNDIVVDLPKTVGAGYGQFWRSRSLYRVVKGSRGSKKSKTTALNYVIRLLKYPWANLLVIRRYSNTNKQSTYTDFKWACNVLGVTHLFKFNESLPEITIKATGQKILFRGLDDELKITSITVDIGSLCWAWFEEAYQIETEDKFSTVVESIRGSLDVPDFFKQITVTFNPWNERHWLKRVFFDEETRRADTFATTTTYKCNEWLDEVDIKRYEDLYHTNPRRARIVCDGEWGVAEGLIYENVTVKDFNKDELLQDSANKLCIGLDFGFTHDPTALCCSLINDTTKEIYVFDEAYKVGLITKEVAKMIKDKGYHRSQIIADSAESRLIEELRSEHGISRIKESRKGKDSIMAGVSKLQGYAIYVHPDCKNIMDEFYSYCYQRDKEGNWLNKPEDKNNHLMDALRYSLQCIEGGKATVRRRSDYGL

SEQ ID NO: 4916 - protein, 159 aa, Streptococcus pneumoniae
VAFFDYSKGGDGKLSGLRIKQKRFADEYIISGNATEAYKKAGYRVSSDRVAGVEGHKLLKNPKIKSYIDERLKQLDSEKIADQQEVLGYLTSVMRGETQEQTLISIGELGQTITDIDVGAKDRIKAAELLGKRHRLWTDKVEADVSGTVVFANESDISD

SEQ ID NO: 4917 - protein, 134 aa, Streptococcus pneumoniae
VNKAKELLKELQDLDMDIQSRIDEINELEAGLLSSPKWSEVKVQGGQTRKVDDVYTQLVVMKEAIEQDTKEVINRKLELGRMINRLKNPKYRAVLRMTYINKGTADSVCYDLNMSRTTYYRLKNEAVLALEEVI

SEQ ID NO: 4918 - protein, 123 aa, Streptococcus pneumoniae
MRPCKYPYSGRRKKQETPSPIFSARPIFDEVPIVEEVKVEFGVEASMGRIYPETLIHLDISGYGNRVHSVHRFPGILLSVGESIQLKMLFYKRLRNFTTDRFLTFRESDWKFFIRDLVNEFKH

SEQ ID NO: 4919 - protein, 145 aa, Streptococcus pneumoniae
MIPKFRVWVKIGKRMVFSDDILAIDYENKEIVTQQVYFENGLPDDRDIYCYDFDEIELMQSTGLKDKNGKEIFEGDIVRTTRFLGRADEIGGFYEYDKEFIGIVKQLEGSWVIDTGSDAVCLWTEIEENEIIGNIYENKEFGGRK

SEQ ID NO: 4920 - protein, 152 aa, Streptococcus pneumoniae
MDDILQALAKMLNMTVDEVSSLLTTFKGNAPQIYEMFVKEKMFYDLFSLFQIMSIVIFSISAVVLAVLTLIYFTYDGGFVYSYDIRTGKTEEEIKLERIERKRKDLKIPLKISCISSSASLITLVIAIVLKATLAPNYIFIVNEILPKLTKR

SEQ ID NO: 4921 - protein, 86 aa, Streptococcus pneumoniae
LKRFIAIWILLSAGLNIWQSIYIKKLEEKRPIVVYKADNAGAEIFGKVVEKGRHGKLYTLTIRDYGVFVVTKDVYEKVKVGDEVLL

SEQ ID NO: 4922 - protein, 231 aa, Streptococcus pneumoniae
MNKQELIKRIEDLPYTEGPIADTIEINRNWILKSIEQLAESEIGHADEAPRYVKNILARLRELPLHDREFWLKAIMSEFEQDFSHAKWREGYEQGKIEGMVEREKVIVPQCVAEYIEFKKKNNFHVYGAMRVIEDHYDKKVPDWFYENNIEKFCLAWLDGYEVEKEKRYFVKIKGNIKENMLVYGELLKRYFFTKSFSLDDVIYSHTRKELENAKIGWVFDCEGFEIEEVE

SEQ ID NO: 4923 - protein, 449 aa, Streptococcus pneumoniae
VIVIGNVVSIDSQPKMITTAKGDIKANSPSNVLMSFKADDQLSIYLKHNDFSQEHELLKDIKIGNTLFKKGELPSNFDSVVKVYFESVLGVAFSSQAMLDGMETFFSERSYNPVIEYMEKAAEKWDGRKRIDRMLQVYLGAEDIPLVSKIAQMWLVGAVAKVYDPYVKFDYVLDLVGGQGVGKTSLLQKLGGEWYTDAVTDFSNKDNYDIMLKSLIVNDDEMVASNRMSFAETKAFISKTSLRYRKPYMKRTEEFAKNFILARTTNQTEYLKDKTGERRFLPVMADSKRQKKHPMEIEPETIEQIWGEAVTIYRAGADLMFDENTEDELNIYREQFMYRDEVELQVLEYLDMPVPENWQNWSIQQQHQYTSKYFDNSSDFDPGSKKLDKVSTREMMYNLFMRNSNDRKLSTKINMIMDNHPDWKKSVFRAGGKSTKGFVRVKDSEKTNR

SEQ ID NO: 4924 - protein, 273 aa, Streptococcus pneumoniae
MPSMKEYALQYQKLGFSVIPINPKNKMPLIEFADKPAMTPSEIENFWDGYPNANIALKTTNFFVIDIDKHGKSNGFESLKKWKHLNLIEPTLQAKTASGGKHLFYFKREDEPITQMIGFLPGVDIKAHENNYVLVAPSATDKGQYEWDLEKSKEGGTMVTPSKYLIQSIKKQYGETHGYKYDGKDGLRDLVRRSHTRDRTQTTDLFETIALGFGDEGGRNDKLAKFVGGLLYRAVDDGVVVQLARLANANSPTPLPEKEMMRTIESMIKKDRR

SEQ ID NO: 4925 - protein, 77 aa, Streptococcus pneumoniae
MAGLSANSIKGILFLGLIGMTENPNFWYCNAYSFIDGMVFSPLCKYKQVPGPYSLTDIHLQSFLNKITTIDKPLQMY

SEQ ID NO: 4926 - protein, 65 aa, Streptococcus pneumoniae
PPFLKNSKFWVIDETDERLGPFNTFEEAYQSLLFYLKMTEDEYQSNYTAQELVYIYKEEKKPCRR

SEQ ID NO: 4927 - protein, 168 aa, Streptococcus pneumoniae
MSLLDIAKSIKKEGFDPRKDSANGPAPIPAGTYPVVLKKATFNVSDKGWESLGYQFEIRGGDYSGRSEFATFGTLTEWNGKNLDWAVERTMKFFIKALVLAGDSMQGNEEDGKALEEALQRKAVGSYYNLVISVTKGKDGREFRNYDLEEEEAQPLTEADIDEDDLPF

SEQ ID NO: 4928 - protein, 275 aa, Streptococcus pneumoniae
MAFTLPANKPQVPKDTPRNFFIYGETMSGKSYLANEFPNPIVLNTDGNAEANTVPSIQLINEKDDKGRITNSVIKQLGDILLALQTQKHSYETVVIDVIDDVIEMIKIAVCDELTPVGKPRLKSLSEIPYGKGYDFFNQAITELVIDLKALPMNVIYISRQVSEYDDNGNATKDKPSLKDKYVNLINGNSDLMIHTEKLGNNYNREVDRKRKTYYADQVDDKAILKILATIRGAVEPAKGKLAPKKEAAKTTKPAKTEKTKEAPKKEVDSDDELF

SEQ ID NO: 4929 - protein, 105 aa, Streptococcus pneumoniae
MNKTTEMIVFRSRKTGEFLNSYKDRSSLAFAADFCSLEYCLKLPRKKYEDNKKTYKALAAAFDCEIVAVEAEYKLTYPNGSEVEPIKRDRSSIEDMIKDIIGGVL

SEQ ID NO: 4930 - protein, 397 aa, Streptococcus pneumoniae
VSITITLRKWQAEAIKRSEHLSNGIFLEALGGRGKTICALAIAKHKKAKKIIITNNRLAILNGWIDAVKFMNFDKGVEIIIQTDRYLQNQVKKGHKLDCDVLIVDEWQNMSSDKQVALYRKIKRKYTIGLSATPIRKKGQNFYPLEKTVFGWATPNNKFDWQKTHGKMVYDPFSYSKEKWEDFQNYESYISSLPNFFRWEEIEGIENAVENNGFEIKFYQKRVASGNPEKLAEFRKLNLVTVDGKTAMAKQSFGRKTFERYLNQTGVAVDFPKLKPVNADTPLMLQLDGLIERAPHDMLIVSKSKQIVNVISERHPEIGIWTGDIQEGLYKKFVVATSQVLGVGVDGLQHKYQTIVVLDPVEEGSGEYDDYRQLLWRITGSRQQHDVNVIEFYYKES

SEQ ID NO: 4931 - protein, 162 aa, Streptococcus pneumoniae
LMKILAIDPSSNKIETSTTGVVLLDNARLVDSWVVSYGMRGFADWFHEIGTNLEFDVVIVEEFKARDNDKSKDNSVAETIAYIQLCYPGAILQFNAGYKSDIPNDLLKILDLWKFEKSHHQDIRAAARLGLFWAMRNDIEEVVHDIGKVVSEYHNNAKKVAS

SEQ ID NO: 4932 - protein, 119 aa, Streptococcus pneumoniae
MELMNKTRVTDSLAVVIGPESIEVLVTEGFLFDVAIRFVKVDETNLDQGNEKPVFTPEYKLVTVAKYKEKPIFESEEDIRKFEKQAKEVKSLFAFAKVNKQNWFNTALYPGVLTEKVGV

SEQ ID NO: 4933 - protein, 160 aa, Streptococcus pneumoniae
MASLYELTGQFLTIYQLDIDDETKADTLEAIDWQEQFEQKAEGYAHVIKNLEADVAMYKAEEESFKAKKQVAQKKLDYVKDNIMAAMNVTGQTEVKSGALIIKIAKNPESVKVNEDDLPKKYFTKKVTLAPDKKTLKELLKSGKKVKGAELVRTEKLVIK

SEQ ID NO: 4934 - protein, 257 aa, Streptococcus pneumoniae
VKSMPRSLCWKDEYTEYMHEICPGRLTPEVTRLLNEKFGTNYNKSQIGGVRKRLGLAVGKVYQGRLLTKEQHDYLVLIQKNKISRNVANEMNQKFGLSLTEKQIKSYRRNNNLHSGLTGRFEKGQTPHNKGKKYPNMPKNGGQFKKGNRPPNYVPVGTINYTTNGYPKEKIGEPNQWVLKHRKVWEDHHGLIPKGYSIVFLDGDKTNYDISNLACLSKNEIARMNQNHLFTSNADLTKSGIGLTKLTNKIREVEKNG

SEQ ID NO: 4935 - protein, 76 aa, Streptococcus pneumoniae
MVRNKIGDLTNTLFAQLETLDDRDLTADELKVELQRSKQMVAISGQILQAGQLALDAEKFKDKVGEVNAPIALLEG

SEQ ID NO: 4936 - protein, 113 aa, Streptococcus pneumoniae
MTQAERIREYYREHPAASYDEVAEVVGTTNSNVRANLAKDIKAGRCVRLEDKSYDYSPYYNHTQALTELVDWKNDNRREWVDMLTRAAEKETDSNVMRLLIKEANKLMKEVTK

SEQ ID NO: 4937 - protein, 62 aa, Streptococcus pneumoniae
MEYIYLVTIVGIGLWSLVNKLDDHAEMKQKERQLMANNVARMNLRNSDKQFTYDVEPPEGLK

SEQ ID NO: 4938 - protein, 86 aa, Streptococcus pneumoniae
LEKRNGNKQENEVSRMNLLSRIKNYFSEEVKETNLDWKEVALDLNQSLIETQEKLQEANQEIADLKKIVAIYKEKEKEKRWNIFTW

SEQ ID NO: 4939 - protein, 90 aa, Streptococcus pneumoniae
MEAVEIVRIKDVIIEKVSANDEELKRIFGCSKRQAGERRREMQKLPSQQKHLLDSGQLVTIKGFYEYLQYRGTKAWKKEMETSKKMRSAG

SEQ ID NO: 4940 - protein, 79 aa, Streptococcus pneumoniae
MTEIHACLCGNWVNLSADDDCVMGPNMASPYIWWEENAELYSPISKPEANSMYHQDYIYIHYRGADYRIHPMFIQIVSR

SEQ ID NO: 4941 - protein, 63 aa, Streptococcus pneumoniae
MKSFKDFRESLTAEDMQAISAKANEATKQIDHTDGLQLGKVSGLTSVITTIELLEKYHEWLHS

SEQ ID NO: 4942 - protein, 67 aa, Streptococcus pneumoniae
MRPRRYPYSGKKESTFVKADPELVEKLLRNTSFLERLQKKPINFQIDSEEFKRLSYEAIHDTSQVTQ

SEQ ID NO: 4943 - protein, 66 aa, Streptococcus pneumoniae
MESVLESLKQEKDHLEKIIKVVTSGGKFLRLPYQKKSRSISENLKLISQNLDKLSEQVQQTTNQHS

SEQ ID NO: 4944 - protein, 71 aa, Streptococcus pneumoniae
VQWTLEAMRINKGLTQAELAEKFEVSSQTIARLEKDSSDIGYQLLKKYMFFFNVKFDDIFLGKKYENFVNN

SEQ ID NO: 4945 - protein, 67 aa, Streptococcus pneumoniae; identical to SEQ ID NO: 4942

SEQ ID NO: 4946 - protein, 229 aa, Streptococcus pneumoniae
MIFRVKVNSSVSRPVTVEDICPNCKKPTNPDLVNSSYFSLGENKTSLVLTCRCLGCKHFWTEEFIATRFLINDYTEKYEIEHIKVIPNLPSDIPISDDVEIVSPIGKQIYVQALKAEHEQLDHIAGIGYRKALEFFVKDFSIVTNPDDEDKIIKMSLKQVIEKYIKDEDLKTFALASAYIGNDEGHYYRNNPDKGFTDLKNYLHGVIHYMEMKLNFLDAQELVNRSKKS

SEQ ID NO: 4947 - protein, 263 aa, Streptococcus pneumoniae
MDEKKRMQIIAENITHFRKQRGITQKELAKEVGITASTMTDYMKLRSAPSFGVIQKLADYFGVKKSDIDTTFKEESTNSLPDAPDSLTQQIMDKVVQLTPPNQKIVLRTSEELLESQNEEETKINEVSEVISLYQVEVVSETAAASGFNYGFGYDDTDRETIEVDERPPRHDIATKVSGDSMQPDYQDGDILYLVDKGLTTYNGDLAIIAYGDRSYFKKIYTENGRLRLVSLNDKYEDIILDFPPAEDTHIKIYAVVGVYRGE

SEQ ID NO: 4948 - protein, 316 aa, Streptococcus pneumoniae
LKPFKTIEEQIATLKIRGLSITDESKAAKYLLSNNYYNIINGYSKFFQHPGTDTYIDGVTFDEVSSLYTFDKDVKRAILQAILEAEHHIKSITAHRFAEAYPSQKYAYLNTNSYADNKILDVGFIVSKLSKIINTNKRYRGNSIHHYAHTHSDVPIWVLTDYLEFGDLRTIIENLPNSLQNEIARDLVSFISTNIPDFNDVFPPETLISFLKNINEVRNKCAHNNRLLNFRCRSNSTFWETIHNKEILMGDDSRKTVYSTIISLQCFISKAAFNILWNTLRKKVIKLEKKLPSIDINVINQSLGFPNDWHRNEPKV

SEQ ID NO: 4949 - protein, 58 aa, Streptococcus pneumoniae
LFRTSLIFFRKDIKVSGGKTSLKSGMFVLIKLTKSRAISFWSELGRFSIIVRKSPNSR

SEQ ID NO: 4950 - protein, 375 aa, Streptococcus pneumoniae
MWMEELPNGKFKYFERYKDPYTEKLKKVSVTMEKKTPQARNQAAILLQEKINKKLSTKQVESITFEEIYNLFYKSWAQTVKESTKHNCKSVDKKMKEVIPSDTILANLDRRFLQEAIEKIIESNGYITAKKVRHRLRGIFNYAVQYSYIENNEVDYTTIPQKPKTLEELEKKRNNFLTMQEIKALVDVLNRREYHQKYADMVLVLTLTGMRYGELTALQLKNIDFENNKIEITGNFDSVNKIKTLPKTTNSIRTIKVSESVIEAIQRQIVRLSERFQPLSSDDYIFCFEKWNQPTTIACFIQILKKYGKQAKIEKNLSSHIFRHSHISFLAESGLPIKSIMDRVGHSNAKMTLEIYSHTTEDMEDKLVNKLDTIF

SEQ ID NO: 4951 - protein, 61 aa, Streptococcus pneumoniae
HNFNNFTAYKHDILCQPSIYKIGHLRNSLSCHLNLCIGDTVILYFVSMLTYFAITSFLNLL

SEQ ID NO: 4952 - protein, 352 aa, Streptococcus pneumoniae
MKDDQKYLLAGLYSLLVAIFYFPLIESKGIFVSILMAVLLLYLIYFIATVIHIVIIKFIRKKSFKYLVLYPFTYDGSWRFQPINLLYFPEMVRDVIPINLVQEYCQGQPYGLLKKMLKRIRLSREISLLLATIIVYFFTHRILPLSVFTFIFSYILLFVQSYLGSNTAWIGNRRLIIDDEFEKILLSKSYIKEISSARYSEYLTCEYKNLTPIILIAIFENLLDSYLLQNQSEVDLDIFYKVLPLLYKEKYTMGFNYFVSLNYLLYKVGFLGIIYDNEALRDLSKQYLNKNISELQDGSFEGGIQDAVASKQIVVINEFIACLNSRCVPSQYDRFFYKDRPYIFSRKSPIKG

SEQ ID NO: 4953 - protein, 63 aa, Streptococcus pneumoniae
SILNIKVKPPSIYLQKSPWTQSMENKILQLEANKVPLINISDHLSFKTPYYLLRIHQYNRATL

SEQ ID NO: 4954 - protein, 70 aa, Streptococcus pneumoniae
MMIVLISVIVAFLYHKITEYVNNRKIDIVIFLSLLISHFIWNYYFLPIEILIAISGANLLLSFLKKLQTK

SEQ ID NO: 4955 - protein, 80 aa, Streptococcus pneumoniae
LYFQNLIFGGLSNEITINNTPKINKNISQTLFSVLIKLPYLSHFLFLNNSYSFSLIKGTEKLEKIIRIENRYTSFCITKT

SEQ ID NO: 4956 - protein, 148 aa, Streptococcus pneumoniae
MMYLDGGGYLSKSACQGICAALAMSPGTFIALTGAAVLTKKLINYIKVGGLGGWLIGAAAGVLALIFLIKICVDTTIKVLLNRIFKASKVMKRRIFSLFVLDLMVYIFLGYVLVIQKDVYLFSILIIFSNFSVPFIREKEYELFKNKK

SEQ ID NO: 4957 - protein, 60 aa, Streptococcus pneumoniae
TIKSSTKRENILLFITLLALKILFNRTFIVVSTQIFIKKIRANTPAAAPISQPPRPPTLI

SEQ ID NO: 4958 - protein, 116 aa, Streptococcus pneumoniae
LSISMLKKYPCTMQHDQSDCAAAVVSTVLLSYKKELSIMKIREIIGTDMYGTTVSGIVSGLNKLNFTVKAVRVALEDLTPKLTFPAILQVKNDLGQNHFVVLHSIKEKIKGTRITK

SEQ ID NO: 4959 - protein, 287 aa, Streptococcus pneumoniae
MRYDFGKVYKEIRESKGLTQEEVCGGVLSRTSLSKIESGKTTPKYENMEFLLRQINMSFEEFEYICQLYQPSQRTEIMQTYLNMRSIIGTSDLVNLFQKCQDYLKTHHDLPIEEIRDMLEVVIYLRQHGAGELSKHAEQVVKKLWKKIEKQDTWYESDLKILNTILFSFPIEYLHLITGKILQRLEVYKNYQHLYDLRMTILLNLSTLYLYNQDKNMCKQICYTLLEDAKNKKSYDRLAICYVRIGICTDDSKLIQKGFSLLELTEETSMLSHLKKEVEIYYQAKER

SEQ ID NO: 4960 - protein, 124 aa, Streptococcus pneumoniae
VFTTMCPCHHESPNDLTRKYDFYVYPNSIMTFFSKVNISHFFNDKKEATNRPTSYSEPITPSLFSFIRFLSDCNLVFDLVIPLTGTTMSNCSRSYLMRYFNQFFRNQRAAQGRYQGILLFIIGM

SEQ ID NO: 4961 - protein, 75 aa, Streptococcus pneumoniae
MVIFLLKMKHFFAGIGEINFVSYLLYICVGIAPFFHVYIIGSEMNFVKIVLSILGIIFVCILTIARIYRTFFYKE

SEQ ID NO: 4962 - protein, 126 aa, Streptococcus pneumoniae
MELVLPNNYVVIDEEEMMYLDGGGVGCNWWNSRGSFATVLDVGLAIYSGGATIYSAYAIKKAISANRGAITRTLRSLIIKHVGSAAGHLVNTALNVALTVTGFSLGGAIAYGADWADGSLDGYIFA

SEQ ID NO: 4963 - protein, 74 aa, Streptococcus pneumoniae
SFHGAGRYNVRELELLVEDKMLRVIVVIQSLVIILLAVALLLSRKNFDSLNVVLIMMIVSQLLLLVYLIKSGNQ

SEQ ID NO: 4964 - protein, 69 aa, Streptococcus pneumoniae
LLLLLTFYPPLTTQAPLHYIDQPHGKIIARLINDIIHTRIQNIFLFILFLLSLFSTYIVPLIKLISKLR

SEQ ID NO: 4965 - protein, 67 aa, Streptococcus pneumoniae
AHFKITLTFFTKRRKLCVMIMDSAFKFLNSIPSFYLYYERKYNNCQVTKVNFIKKLQAKFVKFTLSR

SEQ ID NO: 4966 - protein, 287 aa, Streptococcus pneumoniae; identical to SEQ ID NO: 4959

SEQ ID NO: 4967 - protein, 172 aa, Streptococcus pneumoniae; identical to SEQ ID NO: 2956

SEQ ID NO: 4968 - protein, 121 aa, Streptococcus pneumoniae
VKQSGRLFQPEPRNLKAKLFSQVIVRAKHIHSNDFDATSDGSIIFKKVISDDSLCSTFKNSDDIELFKILRNKAHLHLPIETVTPRTVSTSQDIILGRFLKLHSKWKSLSFRMTVEVEMES

SEQ ID NO: 4969 - protein, 95 aa, Streptococcus pneumoniae
MSFIAQDFEKLDIITVLEGRTQAVIRDHFLKYDRAVRCRVKIITMDMFSPYYDLAKQLRFQISRLRLKQSPRLFHSRMLKSFLIAFTLCNILAVL

SEQ ID NO: 4970 - protein, 255 aa, Streptococcus pneumoniae; identical to SEQ ID NO: 4700

SEQ ID NO: 4971 - protein, 156 aa, Streptococcus pneumoniae
LRMPLKRPLKNRKKEKNMSKEKVILAYSGGLDTSVAITWLKKDYDVVAVCMDVGEGKDLDFIHDKALKVGAVESYVIDVKDEFATDYVLVAHQSHAYYEQKYPLVSALSRPLISKKLVEIAHQIGATTIAHGCTGKGNDQVEYQIAVAKKANEAKK

SEQ ID NO: 4972 - protein, 265 aa, Streptococcus pneumoniae
MKKVLMTMFGLVMLPLLFACSNNQSAGIEAIKSKGKLVVALNPDFAPFEYQKVVDGKNQIVGSDIELAKAIATELGVELELSPMSFDNVLASVQSGKADLAISGVSKTDERSKVFDFSTPYYTAKNKLIVKKSDLATYQSVNDLAQKKVGAQKGSIQETMAKDLLQNSSLVSLPKNGNLITDLKSGQVDAVIFEEPVAKGFVENNPDLAIADLNFEKEQDDSYAVAMKKDSKELKEAVDKTIQKLKESGELDKLIEDAFKASIEK

SEQ ID NO: 4973 - protein, 213 aa, Streptococcus pneumoniae
MIELKNITKTIGGKVILDNLSLRIDQGDLVAIVGKSGSGKSTLLNLLGLIDGDYSGRYEIFGQTNLAVNSAKSQTIIREHISYLFQNFALIDDETVEYNLMLALKYVKLPKKDKLKKVEEILERVGLSATLHQRVSELSGGEQQRIAVARAILKPSQLILADEPTGSLDPENRDLVLKFLLEMNREGKTVIIVTHDAYVAQQCHRVIELGEGK

SEQ ID NO: 4974 - protein, 58 aa, Streptococcus pneumoniae
MTVFPSRFISKRNFKTKSLFSGSSEPVGSSAKISWLGFKMALATAIRCCSPPDNSETL

SEQ ID NO: 4975 - protein, 438 aa, Streptococcus pneumoniae
LIINPKDLFPILWLSHFLLLQLYLFISWLTYLLIQKMTISSLLKGFSSFKFGLIFNYVMKIGTTILLTALLIGVGRSLEQENKELAYQQQWVSQGNYLTLETFKLNDNLWQEELAGSGKSTDYFYRFYQDLVEKTQAGYVQSSSLPVKNFVQSEQIQQYQLTDTVDVYYANRNFLKSKGFKLPDTGIKKVILMPASTKGEEDKNQLLGKLIAFHSMKYEEQQKRTIEEMDVEIAYYEGDWSFFPYSDKRKENLSNPIISLVNDSDMMWDEKASLSTTGLNNPIKIENTVQHQKEITELVEKLSDGNYLKFSSIQAIQQEKVDSYRDAVRNFNLLFALFGLLSMMISYFLLVTTFLLKRRDIITKKFMGWKLVDRYRPLLVLLLLGYSFPLLVLIFFAHAFLPLLLFAGFTCLDILFVLGLASRMEKRSLVELLKGGIL

SEQ ID NO: 4976 - protein, 370 aa, Streptococcus pneumoniae
LERENCSGGTFMKKISNFCMLLLLLCTTFFVFNVNYTREVVRIQEMGKTVDSLDLYLKDINEPAASVLRFFEDVSKEYKVSIIKTDSGDEVVKSGVFDKDTFPYQEFGISSLDFTTDGEGVYSNKEISNKLGTIPTFLKAKPIQLMTFQTYIKDTSRSLNGRYTITSTQEMDKDRIVQKWSDFFKIDQATLLEPTYKSAVEVINRDLLLSAIVFVLAILLLVLVTVYQPMMEMKRVGVQKLLGFQDRAVLADVVKGNLYLLLGGALVINLGVFFLLDYKPKRFVSYTVVVSFFAVAALSLYQLVDLPLNPKNDNQLSAERFFIFQIWSYLQLCDENRDNYFTDGLTDWGGQKFRTRKQRTCLSATVGKSR

SEQ ID NO: 4977 - protein, 71 aa, Streptococcus pneumoniae
LNILITYILLDIIQQLLDMGVEPLRIMQNLRHGLELPSPRFRQQEWNISMDLSKILPSPIWRGKTVVEALL

SEQ ID NO: 4978 - protein, 83 aa, Streptococcus pneumoniae
MECGILENTNALTVWVEGGQWNYGVGWTGTFEYSDYLHSTRYHTATVRHGGRTSKDYAKPEAWARASLTKIPPTGMEYFYGFE

SEQ ID NO: 4979 - protein, 287 aa, Streptococcus pneumoniae; identical to SEQ ID NO: 4959

SEQ ID NO: 4980 - protein, 195 aa, Streptococcus pneumoniae
MKSITKKIKATLAGVAALFAVFAPSFVSAQESSTYTVKEGDTLSEIAETHNTTVEKLAENNHIDNIHLIYVDQELVIDGPVAPVATPAPATYAAPAAQDETVSAPVAETPVVSETVVSTVSGSEAEAKEWIAQKESGGSYTATNGRYIGRYQLTDSYLNGDYSAENQERVADAYVAGRYGSWTAAKNFWLNNGWY

SEQ ID NO: 4981 - protein, 96 aa, Streptococcus pneumoniae
ADTNDGANTANKAATPARVALIFLVIDFIFENSPSFYSSIIPFKYYRFLTLLCRNITKLFFISLNKVFFVIKDTIFMLFEVLERFSSTIKAKPLIL

SEQ ID NO: 4982 - protein, 223 aa, Streptococcus pneumoniae
MKSLRFQSVFDIIGPVMIGPSSSHTAGAVRIGKIVSSIFDDTPTEVEFQLFNSFAKTYRGHGTDLALVAGILGMDTDDPEIPNSLEIAHKRGIKIVWTIQKDSNAPHPNTTKITVKNAHKTISVTGISIGGGNIQVTELNGFAVSLNMNTPTIIIVHQDIPGMIALVTEALSRYGINIAQMNVTREKAGEKAIMIIEVDSRNCDEAIEEIRKIPHLHNVNFFK

SEQ ID NO: 4983 - protein, 290 aa, Streptococcus pneumoniae
MFYSIKELVEQADLDFQGNVAELMITTEFELTGREREEVFLLMERNLEVMKASVQLGLNENKSRSGLTGGDAAKLDHYIKNEKTLSDYTILSAARNAIAVNEHNAKMGLVCATPTAGSAGCLPSVLTAAIEKLDLSHEQQLDFLFAAGAFGLVIANNASISGAEGGCQAEVGSASAMSAAALTLAAGGTPYQASQAIAFVIKNMLGLICDPVAGLVEVPCVKRNAMGASFAFIAADMALAGIESKIPVDEVIDAMYQVGASMPTAFRETAEGGLATTPTGRRLQKEIFGE

SEQ ID NO: 4984 - protein, 177 aa, Streptococcus pneumoniae
LSFIDAFCLIVRTIYLHGFRNLVFGQAGRKTTFERWSHKTTNSFGIRARHPQLFKGIGKGIVNPDRTINEGSIQIEKNRCDRGHGFSYLISLFSENFFLEATTSRGGSESTFSCFTKGSWHACSYLVHGIDHFIHRDFRFDTCQGHVCCDESKASSHGITFDTGNFDQTCNRVTDEA

SEQ ID NO: 4985 - protein, 210 aa, Streptococcus pneumoniae
MTSITAIFFDLDGTLVDSSIGIHNAFTYTFKELGVPSPDAKTIRGFMGPPLESSFATCLSKDQISEAVQIYRSYYKAKGIYEAQLFPQIIDLLEELSSSYPLYITTTKDTSTAQDMAKNLEIHHFFDGIYGSSPEAPHKADVIHQALQTHQLAPEQAIIIGDTKFDMLGARETGIQKLAITWGFGEQADLLNYQPDYIAHKPLEVLAYFQ

SEQ ID NO: 4986 - protein, 71 aa, Streptococcus pneumoniae
QTRKLAAGCSKHCFKVVDGTDEVSSKHCFEVVDRTDEVSNHTYGKATLTWFEEIFEEYKSLHNKTHITKVV

SEQ ID NO: 4987 - protein, 616 aa, Streptococcus pneumoniae
MNKKLTDYVIDLVEILNKQQKQVFWGIFDIFSMVVSIIVSYILFYGLINPAPVDYIIYTSLAFLFYQLMIGFWGLNASISRYSKITDFMKIFFGVTASSVLSYSICYAFLPLFSIRFIILFILLSTFLILLPRITWQLIYSRRKKGSGDGEHRRTFLIGAGDGGALFMDSYQHPTSELELVGILDKDSKKKGQKLGGIPVLGSYDNLPELAKRHQIERVIVAIPSLDPSEYERILQMCNKLGVKCYKMPKVETVVQGLHQAGTGFQKIDITDLLGRQEIRLDESRLGAELTGKTILVTGAGGSIGSEICRQVSRFNPERIVLLGHGENSIYLVYHELIRKFQGIDYVPVIADIQDYDRLLQVFEQYKPAIVYHAAAHKHVPMMERNPKEAFKNNIRGTYNVARAVDEAKVSKMVMISTDKAVNPPNVMGATKRVAELIVTGFNQRSQSTYCAVRFGNVLGSRGSVIPVFERQIAEGGPVTVTDFRMTRYFMTIPEASRLVIHAGAYAKDGEVFILDMGKPVKIYDLAKKMVLLSGHTESEIPIVEVGIRPGEKLYEELLVSTELVDNQVMDKIFVGKVNVMPLESINQKIGEFRTLSGDELKQAIIAFANQTTHIE

SEQ ID NO: 4988 - protein, 83 aa, Streptococcus pneumoniae
HHLLGQVINLDWFAHIKDKDFPIFGISTSMDNQTTSFWNGHKVTGHAEVCHRYRPTFSNLTFKDWNDTTTATKNIPKTNCTVG

SEQ ID NO: 4989 - protein, 391 aa, Streptococcus pneumoniae
GFFTIMSSKVSGFQDKNGKVLKIMIEWWKEKFRRVVVTQNVESLLVSIVISACNEEKYLPGLIEDLKNQTYPKENIEILFINAMSTDGTTAIIQQFIKEDTEFNSIRLYNNPKKNQASGFNLGVKHSVGDLILKIDAHSKVTESFVMNNVAIIQQGEFVCGGPRPTIVEGKGKWAETLHLVEENMFGSSIANYRNSSEDRYVSSIFHGMYKREVFQKVGLVNEQLGRTEDNDIHYRIREHGYKIRYSPSILSYQYIRPTFKKMLHQKYSNGLWIGLTSHVQFKCLSLFHYVPCLFVLSLVFSLALLPITFVFITLLLGAYFLLLSLLTLLTLLKHKNGFLIVMPFLLFSIHFAYGLGTIVGLIRGFKWKKEYKRTIIYLDKISQINQNMLQ

SEQ ID NO: 4990 - protein, 101 aa, Streptococcus pneumoniae
LGVSFELPFLVYPFFLGNISQVLEVKVSSLGGFDQLASPYVYPLFTIFYPTGSENRLGASLHLQPLLLDHRLTYSTNQSAPALSRNLDGWGKCRSHQCPAS

SEQ ID NO: 4991 - protein, 248 aa, Streptococcus pneumoniae
LVVLTSLPLLMFTLFSPFSTQLAQKIGLEHLFTYSLFFLTIGSLIRLINLPLLYLGTLMVGASVAVINVLLPSLIQANQPKKIGFLTTLYVTSMGIATALASYLAVPITQASSWKGLILLLTLLCLATFLVWLPNHRYNHRLAPQTKQKSQIKVMRNKQVWATIILAGFQSLMFYTVMTWLPPMSIHAGLSSVEVGSMTSILSNDKHSFYNDHPKPGNQFIDSQPSAHAHSGFTSWCGRHLHALFPNQ

SEQ ID NO: 4992 - protein, 142 aa, Streptococcus pneumoniae
MISIPFTMTIPSLATSLSTRNRQLMLTLVSLAGVVGICMLFFPINNFIYWLAIHLLMGTATSALFPYLMVNFSLKTSAPEKTAQLSGLSQTGGYILAAFGPTLFGYSFDLFHSWVPAVAALLLIDILMTVALFTVDRADKIL

SEQ ID NO: 4993 - protein, 108 aa, Streptococcus pneumoniae
MYFPTSSALIEFLILAVLEQGDSYGYEISQTIKLIANIKESTLYPILKKLEGNSFLTTYSREFQGRMRKYYSLTNGGIEQLLTLKDEWTLYTDTINGIIEGSIRHDKN

SEQ ID NO: 4994 - protein, 197 aa, Streptococcus pneumoniae
MTRTEYLTQLELYLKKLPEADRIEAMDYFRELFDDAGVEGEEELIASLGTPKEVAHEVLSNLLDKKINEAPAQKNNRQILHIALLALLAAPIGIPLGIAILVTLFAILVAALTVILAFFAVSILGIIGGFLFLVESFTVLAQAKSAFILIFGSGLLAIGASSLVLLGISYVARFFGLLIVRLVQFVLKKGKRGNQHA

SEQ ID NO: 4995 - protein, 303 aa, Streptococcus pneumoniae
MRKWTKGFLIFGVVTTVIGFILLFVGIQSDGIKSLLSMSKEPVYDSRTEKLTFGKEVENLEITLHQHALTITDSFDDQIHISYHPSLSAHHDLITNQNDRTLSLTDKKLSETPFLSSGIGGILHIASSYSSRFEEVILQLPKGRTLKGINISANRGQTTIINASLENATLNTNSYILRIEGSRIKNSKLTTPNIVNIFDTVLTDSQLESTENHFHAENIQVHGKVELTAKDYLRIILDQKESQRINWDISSNYGSIFQFTREKPESRGTELSNPYKTEKTDVKDQLIARSDDNIDLISTPSRR

SEQ ID NO: 4996 - protein, 122 aa, Streptococcus pneumoniae
LLRKSFLALFSYSDFFCFFRKVWLFFSRIRCLLFFYFCSRFTDFRSFNFLFLLAFQFDFSLRDFLLYLSIFSNWCIEIGYRFFSLVCNLLSLLFRLVLACCFYKIITFKPFLFHGRTSFLVR

SEQ ID NO: 4997 - protein, 354 aa, Streptococcus pneumoniae
MKQEWFESNDFVKTTSKNKPEEQAQEVADKAEETIADLDTPIGKNTQVEEEVSQAEVELESQQEEKIETPEVGEARTEIEEKKASNSTEEEPDLSKETEKVTIAEESQEALPQQKATTKEPLLISKSLESPYIPDQAPKSRDKWKEQVLDFWSWLVEAIKSPTSKLETSITHSYTAFLLLILFSASSFFFSIYHIKHAYYGHIASINSRFPEQLAPLTLFSIISILVATTLFFFSFLLGSFVVRRFIHQEKYWTLDKVLQQYSQLLAIPIFLTAIASFFAFFDSLRFTALLCVISIGIILLASLHIITRPSQASETDSFYQLFLSVLVNGVIILLFFVAEVALIGDYLRILAFL

SEQ ID NO: 4998 - protein, 317 aa, Streptococcus pneumoniae
LKRFSKSIKFVFVSFRKIRYTVCKRFQRSPVMAKTFFIPNKQSILGEQEILNAKSILALLDGLESHSYDVVYLRQPLNRLEYIECAIVGQSQFLFKVSYADGQKAYRVDLPDLLTKTDWQIIKSFLDALLAYTGTDIEGLDGFDFEAYFQASIQAYLADAVARFTICQGIFNPIFFSRENLKSFLEADGLAQFEARVRAVQETDAYFARVSFYQDGEGKVHGVYHLAQGVKTVLPREPFVPAAYIEQLVDKEVQWEIDLVQITGDGSKPEDYESIARLDYAKFLEVLPPSFYHQLDANQIEIQPILGQDFKTLAQEK

SEQ ID NO: 4999 - protein, 328 aa, Streptococcus pneumoniae
MAKDIRVLLYYLYTPIENAEQFAADHLAFCKSIGLKGRILVADEGINGTVSGDYETTQKYMDYVHSLPGMEDLWFKIDEESEQAFKKMFVRYKKEIVHLGLEDNDFDNDINPLETTGAYLSPKEFKEALLDKDTVVLDTRNDYEYDLGHFRGAIRPDIRNFRELPQWVRDNKEKFMDKRVVVYCTGGVRCEKFSGWMVREGYKDVGQLHGGIATYGKDPEVQGELWDGKMYVFDERIAVDVNHVNPTIVGKDWFDGTPCERYVNCGNPFCNRRILTSEENEDKYLRGCSHECRVHPRNRYVSKNELTQAEVIERLAAIGESLDQAATV

SEQ ID NO: 5000 - protein, 68 aa, Streptococcus pneumoniae
MFSLVLILTIQEISRTLYNFQSNKLHSFSQAGILVWINKKFRKFKNRKENKSYGKRYSCLTLLPLYSN

SEQ ID NO: 5001 - protein, 514 aa, Streptococcus pneumoniae
LIFIEYKIITLFISLKIKKGVFIMKNWKKYAFASASVVALAAGLAACGNLTGNSKKAADSGDKPVIKMYQIGDKPDNLDELLANANKIIEEKVGAKLDIQYLGWGDYGKKMSVITSSGENYDIAFADNYIVNAQKGAYADLTELYKKEGKDLYKALDPAYIKGNTVNGKIYAVPVAANVASSQNFAFNGTLLAKYGIDISGVTSYETLEPVLKQIKEKAPDVVPFAIGKVFIPSDNFDYPVANGLPFVIDLEGDTTKVVNRYEVPRFKEHLKTLHKFYEAGYIPKDVATSDTSFDLQQDTWFVREETVGPADYGNSLLSRVANKDIQIKPITNFIKKNQTTQVANFVISNNSKNKEKSMEILNLLNTNPELLNGLVYGPEGKNWEKIEGKENRVRVLDGYKGNTHMGGWNTGNNWILYINENVTDQQIENSKKELAEAKESPALGFIFNTDNVKSEISAIANTMQQFDTAINTGTVDPDKAIPELMEKLKSEGAYEKVLNEMQKQYDEFLKNKK

SEQ ID NO: 5002 - protein, 133 aa, Streptococcus pneumoniae
LAPTFSSMILLAFANNSSKLSGLSPIWYILITGLSPESAAFLLLPVKFPQAARPAARATTLADAKAYFFQFFMIKTPFFIFKLINNVMILYSMKIKEQTRKLAAGCSKHCFEVVDKTDEVSYIYLRQGDVDTV

SEQ ID NO: 5003 - protein, 307 aa, Streptococcus pneumoniae
MAKKKIKKEKIDNVGIHSFSKKADIFFSIISGLIALSCILPFVFVIIISVTDEKSLLQYGYSFFPSQFGLDGFEFLAQFKDKILQALFISVFVTVVGTLTNVFITTTYAYAISRTTFKYRRFFTIFVLLSMLFNAGLVPGYIMVTRVLQLGDTVWALIVPMLLSPFNIILMRSFFKKTIPEAILESARIDGASEARIFFQICLPLSLPGIATITLLTALGFWNDWFNALLYIKSDNLYPLQYLLMQIQQNMDYIAKAVGLTGQLGVALPKETGRMAMVVVATLPIAILYPFFQRYFVKGLTIGGVKE

SEQ ID NO: 5004 - protein, 319 aa, Streptococcus pneumoniae
MDIKIKREEIMKKFSKTLRDNWIFLLMVLPGALWLILFFYIPVFGNVVAFKDYHMTSNGFIDSIINSKWVGLDNFRFLFSSRDAFIITRNTVLYNLGFIFLGLVVSVGIAIILSELRSKRMVKIFQTSMLFPYFLSWVIISFFTDAFLNIDKGVFNHLLESLGLKEVNFYADLGIWPYLLLFLGIWKGFGYSSVMYYATIMGIDPTYYEAATVDGASKWQRIRNVTIPQLTPLVTVLTILAVGNIFRADFGLFYQIPHNAGQLYNVTNVLDVYVFNGLTQTADIGMAAAAGLYQSVVGLILVILSNLLARRVDPNSALF

SEQ ID NO: 5005 - protein, 69 aa, Streptococcus pneumoniae
CNRYQKSKKEFLDGYQNKKGGNYEKVFKNIERQLDLSLDGFARGTLVDSILLHSSIWERGCLQRLPHDQ

SEQ ID NO: 5006 - protein, 119 aa, Streptococcus pneumoniae
LRSLTGVSNLTTDSARLVLAEAKKAFADDSLTEQGLRDILQTVKDAIASLESIKESQSATKDGGQTAGKETADKDVLENSQEELQKAVLFLADEKGSEHTEAELIDNLKEVIAKLKANA

SEQ ID NO: 5007 - protein, 115 aa, Streptococcus pneumoniae; identical to SEQ ID NO: 4727

SEQ ID NO: 5008 - protein, 176 aa, Streptococcus pneumoniae
MSRYTGPSWKQARRLGLSLTGTGKELARRKYVPGQHGPNNRSKLSEYGLQLAEKQKLRFTYGVGEKQFRNLFVQATKIKGGILGFNFMLLLERRLDNVVYRLGLATTRRQARQFVNHGHILVDGKRVDIPSYRVTPGQVISVREKSLKVPAILEAVEATLDVQHSYHSTLKNWKVH

SEQ ID NO: 5009 - protein, 358 aa, Streptococcus pneumoniae
DRETERTNMKLKSYILVGYIISTLLTILVVFWAVQKMLIAKGEIYFLLGMTIVASLVGAGISLFLLLPVFTSLGKLKEHAKRVSAKDFPSNLEVQGPVKFQQLGQTFNEMSHDLQVSFDSLEESEREKGLMIAQLSHDIKTPITSIQATVEGILDGIIKESEQAHYLATIGRQTERLNKLVEELNFLTLNTARNQVETTSKDSIFLDKLLIECMSEFQFLIEQERRDVHLQVIPESARIEGDYAKLSRILVNLVDNAFKYSAPGTKLEVVTKLEKGQLSISVTDEGQGIAPEDLENIFKRLYRVETSRNMKTGGHGLGLAIARELAHQLGGEITVSSQYGLGSTFTLVLNLSGSENKA

SEQ ID NO: 5010 - protein, 232 aa, Streptococcus pneumoniae
MGKTILLVDDEVEITDIHQRYLIQAGYQVLVAHDGLEALELFKKKPIDLIITDVMMPRMDGYDLISEVQYLSPEQPFLFITAKTSEQDKIYGLSLGADDFIAKPFSPRELVLRVHNILRRLHRGGETELISLGNLKMNHSSHEVQIGEEMLDLTVKSFELLWILASNPERVFSKTDLYEKIWKEDYVDDTNTLNVHIHALRQELAKYSSDQTPTIKTVWGLGYKIEKPRGQT

SEQ ID NO: 5011 - protein, 123 aa, Streptococcus pneumoniae
LDNIVATKKVTIKINVKETSDTANGSLSPSNSGSGVTPMNHNHATGTTDSMPADTMTSSTNTMAGENMAASANKMSDTMMSEDKAMLPNTGETQTSMASIGFLGLALAGLLGGLGLKNKKEEN

SEQ ID NO: 5012 - protein, 890 aa, Streptococcus pneumoniae
MKFNPNQRYTRWSIRRLSVGVASVVVASGFFVLVGQPSSVRADVVNPTPGQVLPEETSGTKEGDLSEKPGDTVLTQAKPEGVTGNTNSLPTPTERTEVSEETNSSSLDTLFEKDEEAQKNPELTDVLKETVDTADVDGTQASPAETTPEQVKGGVKENTKDSIDVPAAYLEKAEGKGPFTAGVNQVIPYELFAGDGMLTRLLLKASDNAPWSDNGTAKNPALPPLEGLTKGKYFYEVDLNGNTVGKQGQALIDQLRANGTQTYKATVKVYGNKDGKADLTNLVATKNVDININGLVAKETVEKAVADNVKDSIDVPAAYLEKAKGEGPFTAGVNHVIPYELFAGDGMLTRLLLKASDKAPWSDNGDAKNPALSPLGENVKTKGQYFYQVALDGNVAGKEKQALIDQFRANGTQTYSATVNVYGNKDGKPDLDNIVATKKVTININGLISKETVQKAVADNVKDSIDVPAAYLEKAKGEGPFTAGVNHVIPYELFAGDGMLTRLLLKASDKAPWSDNGDAKNPALSPLGENVKTKGQYFYQVALDGNVAGKEKQALIDQFRANGTQTYSATVNVYGNKDGKPDLDNIVATKKVTININGLISKETVQKAVADNVKDSIDVPAAYLEKAKGEGPFTAGVNHVIPYELFAGDGMLTRLLLKASDKAPWSDNGDAKNPALSPLGENVKTKGQYFYQVALDGNVAGKEKQALIDQFRANGTQTYSATVNVYGNKDGKPDLDNIVATKKVTININGLISKETVQKAVADNVKDSIDVPAAYLEKAKGEGPFTAGVNHVIPYELFAGDGMLTRLLLKASDKAPWSDNGDAKNPALSPLGENVKTKGQYFYQLALDGNVAGKEKQALIDQFRANGTQTYSATVNVYGNKDVNQTWTTS

SEQ ID NO: 5013 - protein, 189 aa, Streptococcus pneumoniae
LIDDIGQFAIWQDRMFGQTAQHGLTNSLKDFWIFLLNIGPQLAFFCQMLRCSRSVEQGTGNHRRDFNMIQQIFSHFGMTHLGQIKLVYQESIDLELLVNALNHHLLIDRLVLTPNQITIEIDRQIVHGLDLLKGRKDKEIIDIKSMFRQLELASTQQICPINQRVHHGILAFGEISDLVPAKNLPNRQD

SEQ ID NO: 5014 - protein, 136 aa, Streptococcus pneumoniae
MYYLPVDFYRYLIGREDQSVNEQVMIKCIDQQLKVNRLLVDQLDLSQVSHPKMREYLLNHIEITTVISSTLLNRSGTTEHLAKKRQLWTYIQQKNPEVFQAIRKTMLSRLTKHSVLPDRKLSNVVYQITKSVYGFN

SEQ ID NO: 5015 - protein, 179 aa, Streptococcus pneumoniae
MKLLSIAIPSYNAAAYLHYCVESLVIGGEQVGILIINDGSQDQTQEIAECLASKYPNIVRAIYQENKCHGGAVNRGLAEASGRYFKVVDSDDWVDPRAYLKILETLQELESKGQEVDVFVTNFVYEKEGQSRKKSMSYDSVLPVRQIFGWDQVGNFSKGQYTMMHSLIYRTDLLRASQF

SEQ ID NO: 5016 - protein, 221 aa, Streptococcus pneumoniae
MSDRTIGILGLGIFGSSVLAALAKQDMNIIAIDDHAERINQFEPVLARGVIGDITDEELLRSAGIDTCDTVVVATGENLESSVLAVMHCKSLGVPTVIAKVKSQTAKKVLEKIGADSVISPEYEMGQSLAQTILFHNSVDVFQLDKNVSIVEMKIPQSWAGQSLSKLDLRGKYNLNILGFREQENSPLDVEFGPDDLLKADTYILAVINNQYLDTLVALNS

SEQ ID NO: 5017 - protein, 459 aa, Streptococcus pneumoniae
MLFKLSKEKIELGLSRLSPARRIFLSFALVILLGSLLLSLPFVQVESSRATYFDHLFTAVSAVCVTGLSTLPVAHTYNIWGQIICLLLIQIGGLGLMTFIGVFYIQSKQKLSLRSRATIQDSFSYGETRSLRKFVYSIFLTTFLVESLGAILLSFRLIPQLGWGRGLFSSIFLAISAFCNAGFDNLGSTSLFAFQTDLLVNLVIAGLIITGGLGFMVWFDLAGHVGRKKKGRLHFHTKLVLLLTIGLLLFGTATTLFLEWNNAGTIGNLPVADKVLVSFFQTVTMRTAGFSTIDYTQAHPVTLLIYILQMFLGGAPGGTAGGLKITTFFVLLVFARSELLGLPHANVARRTIAPRTVQKSFSVFIIFLMSFLIGLILLGITAKGNPPFIHLIFETISALSTVGVTANLTPDLGKLALSVIMPLMFMGRIGPLTLFVSLADYHPEKKDMIHYMKADISIG

SEQ ID NO: 5018 - protein, 61 aa, Streptococcus pneumoniae
MLLTSSVLSATSKQCFELTSSVLSTTSKQCFEQPVTSFLSDALVLIAYNQKEKFSPEKHIE

SEQ ID NO: 5019 - protein, 254 aa, Streptococcus pneumoniae
MIQKHAIPILEFDDNPQAVIMPNHEGLDLQLPKKCVYAFLGEEIDRYAREVGADCVGEFVSATKTYPVYVINYKGEEVCLAQAPVGSAPAAQFMDWLIGYGVEQIISTGTCGVLADIEENAFLVPVRALRDEGASYHYVAPCRYMEMQPEAIAAIEEVLEDRGIPYEEVMTWTTDGFYRETAEKVAYRKEEGCAVVEMECSALAAVAQLRGVLWGELLFTADSLADLDQYDSRDWGSEAFNKALELSLASVHHL

SEQ ID NO: 5020 - protein, 62 aa, Streptococcus pneumoniae
QSVKEETDELDKKQAYIVSCHSGLRSYIAEPILKQAGFTAQNLDGAYSLYKMVNPEGVEYGN

SEQ ID NO: 5021 - protein, 98 aa, Streptococcus pneumoniae
METSISMADFYGKYQNENLELIDVREAHEFQAGHAPGAKNLPLSTLEQGYKELKPDHEYYVICQGGVRSASTCQFLSSQGLTVTNVEGGMNAWPGQVE

SEQ ID NO: 5022 - protein, 120 aa, Streptococcus pneumoniae
MKIKVQTRKLAAGCSKHCFKVVDGTDEVSSKHCFEVVDRTDEVSNHIYGKVKLTWFEEIFEEYKSLHNKTHITKVLMNCTPKVRQKKSNFWGSVHSTPDTMRFFNFKDFLQLLLTHIKLF

SEQ ID NO: 5023 - protein, 97 aa, Streptococcus pneumoniae
RYNEEKSSKEKELTNSKYITCLKRSEGQLCGIQKMIEGDRDCADIVTQLTAVKSSVERVIEMIITENLTECINQPLDDSEAQKERLEKAIRYLIKRK

SEQ ID NO: 5024 - protein, 81 aa, Streptococcus pneumoniae
LGERVEPVILAEGTRMGHIHLSVKDSRKSSQFYQKVLGLENKFSVPGASWIAAGDYHHHLAVNEWGGKGLASRKQGLPGLA

SEQ ID NO: 5025 - protein, 131 aa, Streptococcus pneumoniae
MTYEYKSHIYLAETALNVKDLASQTAFYQQVIGLEILSQTETESILGLGGKVLVQLIQAQESGEVREYYGLYHLAILLPTRKALADVLKHLTDLQIPLVGGADHGYSEAIYLEDLEGNGIELYRDKPFSTW

SEQ ID NO: 5026 - protein, 345 aa, Streptococcus pneumoniae
MKAYTERVFGNVEGEDVLAYRFETDGGYQLEVMTYGATILRYVAPDKAGNFANVILGFDDFDSYVGNSPKHGASVGPVAGRIAGATFELNGKTYDLEVNNASNCNHSGSTGWDSSLFEVEEVSDHGLTLYTERTDGTGGFPGNLKIWISYHLEETGAYEISYKVTTDQDTLVNPTNHSYFNLSGDFTQTIDRHVFQLNTEGIYSIAPDGVPAKTPEANRDVVKHVYNGTLLKDIFAEEDEQIQLASGLDHPFALPAGHDNAGFLYDQNSGRFLLFKTEAPCFVVYTANFVDESVIIGGQPMLQHNGIALEAQALPDAIHSDLKGQVILKAGQTFTSKTRYELVVK

SEQ ID NO: 5027 - protein, 152 aa, Streptococcus pneumoniae
VITVASIINLKVIGLTIELKGRTCNTTRYRTYTCSMLGTIAYITIKVIKSQDNIGKISSLVRCDIAQDSRTISHNLKLVATVCLKSIGQDILTLNISKYTLCVCFHSVLLLLFLSSKQTIESVLTIYGLSDNLQILLSRIHKHCLTFDIREL

SEQ ID NO: 5028 - protein, 388 aa, Streptococcus pneumoniae
MLHYTKEDLLELGAEITTREIYQQPDVWREAFEFYQAKREEIAAFLQEIADKHDYIKVILTGAGTSAYVGDTLLPYFKEVYDERKWNFNAIATTDIVANPATYLKKDVATVLVSFARSGNSPESVATVDLAKSLVDELYQVTITCAADGKLALQAHGDDRNLLLLQPAVSNDAGFAMTSSFTSMMLTTLLVFDPTEFAVKSERFEVVSSLARKVLDKAEDVKELVDLDFNRVIYLGAGPFFGLAHEAQLKILELTAGQVATMYESPVGFRHGPKSLINENTVVLVFGTRTDYTRKYDLDLVREVAGDQIARRVVLLSDQAFGLENVKEVALGCGGVLNDIYRVFPYIVYAQLFALLTSLKVENKPDTPSPTGTVNRVVQGVIIHEYQK

SEQ ID NO: 5029 - protein, 82 aa, Streptococcus pneumoniae
LRQSYPATSKQCFEQPAASFLQILVGTRFNSCDNVKIVRAFYIEYTWEWSLLPFPYLIEKEELNATLYKRRLARIGCRNHYA

SEQ ID NO: 5030 - protein, 134 aa, Streptococcus pneumoniae
MTKSLILVSHGRFCEELRGSTEMIMGLQDNIYTVALLPEDGPEEFTAKFEAVIEGLDDFLVFADLLGGTPCNVVSRLIMEGRDIDLYAGMNLPMVIEFINASLTGADADYKSRAAESIVKVNDLLAGFDDDEDE

SEQ ID NO: 5031 - protein, 276 aa, Streptococcus pneumoniae
VGKSKMTNSNYKLTKEDFNQINKRSLFTFQLGWNYERMQASGYLYMILPQLRKMYGDGTPELKEMMKVHTQFFNTSPFFHTIIAGFDLAMEEKDGVGSKDAVNGIKTGLMGPFAPLGDTIFGSLVPAIMGSVAATMAIAGQPWGIFLWIAVAVAYDIFRWKQLEFAYKEGVNLINNMQSTLTALIDAASVLGVFMMGALVATVINFEISYKLPIGEKMIDFQDILNQIFPRLLPAIFTAFIFWLLGKKGMNSTKAIGIIIVLALALSALGHFALGM

SEQ ID NO: 5032 - protein, 301 aa, Streptococcus pneumoniae
MIQWWQILLLTLYSAYQICDELTIVSSAGSPVFAGFITGLIMGDVTTGLLIGGNLQLFVLGVGTFGGASRIDATSGAVLATAFSVSQGIDAPLAITTIAVPVAALLTYFDVLGRMTTTFFAHRVDAAIERFDYKGIERNYLLGAIPWALSRALPVFFALAFGGAFVQSVVDFVEAYKWVADGLTLAGRMLPGLGFAILLRYLPVKRNLHYLAMGFGLTAMLTVLYSYVTGLGGAVAGIVGTLPAEVAEKIGFVNNFKGLSMIGISIVGIFLAVLHFKNSQKVAVAAPSTPSESGEIEDDEF

SEQ ID NO: 5033 - protein, 158 aa, Streptococcus pneumoniae
MTIVGCRIDGRLIHGQVANLWAGKLNVSRIMVVDDEVVNNDIEKSGLKLATPPGVKLSILPVEKAAANILAGKYDSQRLFIVARKPDRFLGLVEAGVPLETLNVGNMSQTPETRSITRSINVVDKDVEDFHKLAEKGVKLTAQMVPNDPISDFLSLLK

SEQ ID NO: 5034 - protein, 508 aa, Streptococcus pneumoniae
LCVRLHLSVRNGNSVGLPAWLLTKNMRIRSSDPTYIEAVGRYYDQLLPRLVPRLLDNGGNILMMQVENEYGSYGEDKAYLRAIRQLMEECGVTCPLFTSDGPWRATLKAGTLIEEDLFVTGNFGSKAPYNFSQRQEFFDEHGKKWPLMCMEFWDGWFNRWKEPIITRDPKELADAVREVLEQGSINLYMFHGGTNFGFMNGCSARGTLDLPQVTSYDYDALLDEKRNPTAKYLAVKKMMATHFSEYPQLEPLYKESMELDAIPLVEKVSLFETLDSLSSPVESLYPQKMEELGQSYGYLLYRTETNWDAEEERLRIIDGRDRAQLYVDGQWVKTQYQTEIGEDIFYQGKKKGLSRLDILIENMGRVNYGHKFLADTQRKGIRTGVCKDLHFLLNWKHYPLPLDNPEKIDFSKGWTQGQPAFYAYDFTVEEPKDTYLDLSEFGKGVAFVNGQNLGRFWNVGPTLSLYIPHSYLKEGANRIIIFETEGQYKEEIHLTRKPTLKHIKGENL

SEQ ID NO: 5035 - protein, 130 aa, Streptococcus pneumoniae
MTRFEIRDDFYLDGKSFKILSGAIHYFRVPPEDWYHSLYNLKALGFNTVETYVAWNLHEPREGEFHFEGDLDLEKFLQIAQDLGLYAIVRPSPFICAEWEFGGLTSLALDQEHANSLIRPNIYRGSWSLL

SEQ ID NO: 5036 - protein, 238 aa, Streptococcus pneumoniae
MAIPKYQYIKDELKNKIISGQFSSGDKFYTEAELISMYDVSSITVVRALNDLAKDGYIVRQQGKGTFVSRARKHKLVEFSDIELFNAKDDKVTVLSIERGNKLVYLEKLGLRGDQFYYKIERIRESNGVVYIYHTSYIPEQYINANYPNLEYYSSIYNRFKLDYHIHMNDEHFEEINEIVFPTPEHAASVLGVDEHFPTVLQTKITKLESTGQVLEYSETYKRSDYYKIKFISCDHDH

SEQ ID NO: 5037 - protein, 1303 aa, Streptococcus pneumoniae
MKHEKQQRFSIRKYAVGAASVLIGFAFQAQTVAADGVTTTTENQPTIHTVSDSPQSSENRTEETPKAELQPETPATDKVASLPKTEEKPQEEVSSTPSDKAEVVTPTSAEKETANKKAEEASPKKEEAKEVDSKESNTDKTDKDKPAKKDEAKAEADKPETEAGKERAATVNEKLAKKKIVSIDAGRKYFSPEQLKEIIDKAKHYGYTDLHLLVGNDGLRFMLDDMSITANGKTYASDDVKRAIEKGTNDYYNDPNGNHLTESQMTDLINYAKDKGIGLIPTVNSPGHMDAILNAMKELGIQNPNFSYFGKESARTVNLDNEQAVAFTKALIDKYAAYFAKKTEIFNIGLDEYANDATDAKGWSVLQADKYYPNEGYPVKGYEKFIAYANDLARIVKSHGLKPMAFNDGIYYNSDTSFGSFDKDIIVSMWTGGWGGYDVASSKLLAEKGHQILNTNDAWYYVLGRNADGQGWYNLDQGLNGIKNTPITSVPKTEGADIPIIGGMVAAWADTPSARYSPSRLFKLMRHFANANAEYFAADYESAEQALNEVPKDLNRYTAESVAAVKEAEKAIRSLDSNLSRAQQDTIDQAIAKLQETVNNLTLTPEAQKEEEAKREVEKLAKNKVISIDAGRKYFTLNQLKRIVDKASELGYSDVHLLLGNDGLRFLLDDMTITANGKTYASDDVKKAIIEGTKAYYDDPNGTTLTQAEVTELIEYAKSKDIGLIPAINSPGHMDAMLVAMEKLGIKNPQAHFDKVSKTTMDLKNEEAMNFVKALIGKYMDFFAGKTKIFNFGTDEYANDATSAQGWYYLKWYQLYGKFAEYANTLAAMAKERGLQPMAFNDGFYYEDKDDIQFDKDVLISYWSKGWWGYNLASPQYLASKGYKFLNTNGDWYYILGQKPEDGGGFLKKAIENTGKTPFNQLASTKYPEVDLPTVGSMLSIWADRPSAEYKEEEIFELMTAFADHNKDYFRANYNALREELAKIPTNLEGYSKESLEALDAAKTALNYNLNRNKQAELDTLVANLKAALQGLKPAATHSGSLDENEVAANVETRPELITRTEEIPFEVIKKENPNLPAGQENIITAGVKGERTHYISVLTENGKTTETVLDSQVTKEVINQVVEVGAPVTHKGDESGLAPTTEVKPRLDIQEEEIPFTTVTRENPLLLKGKTQVITKGVNGHRSNFYSVSTSADGKEVKTLVNSVVAQEAVTQIVEVGTMVTHVGDENGQAAIAEEKPKLEIPSQPAPSTAPAEESKALPQDPAPVVIEKKLPETGTHDSAGLVVAGLMATLAAYGLTKRKED

SEQ ID NO: 5038 - protein, 129 aa, Streptococcus pneumoniae
MISLSCSGEKYLRPASIETIFFFASFSFTVAARSFPASVSGLSASAFASSFLAGLSLSVLSVFDSLESTSFASSFLGLASSAFLLAVSFSAEVGVTTSALSLGVELTSSCGFSSVFGRLATLSVAGVSG

SEQ ID NO: 5039 - protein, 432 aa, Streptococcus pneumoniae
MINRYSRPEMANIWSEENKYRAWLEVEILSDEAWAELGEIPKEDVALIRKKADFDIDRILEIEQETRHDVVAFTRAVSETLGEERKWVHYGLTSTDVVDTAYGYLYKQANDIIRRDLENFTNIIADKAKEHKFTIMMGRTHGVHAEPTTFGLKLATWYSEMKRNIERFEHAAAGVEAGKISGAVGNFANIPPFVEEYVCDKLGIRAQEISTQVLPRDLHAEYFAVLASIATSIERMATEIRGLQKSEQREVEEFFAKGQKGSSAMPHKRNPIGSENMTGLARVIRGHMITAYENVALWHERDISHSSAERIITPDTTILIDYMLNRFGNIVKNLTVFPENMIRNMNSTFGLIFSQRAMLTLIEKGMTREQAYDLVQPKTAYSWDNQVDFKPLLEADSEVTSRLTQEEIDEIFNPVYYTKRVDDIFERLGLGD

SEQ ID NO: 5040 - protein, 75 aa, Streptococcus pneumoniae
MIQIIVNTFIEKDRTGAVVEVLYASADQDKVQAKYEELAAQYPENYLAIYDVPLDTDLNTLDHYPSVFIEKEEFE

SEQ ID NO: 5041 - protein, 383 aa, Streptococcus pneumoniae
LRMHLPTLLKNKEKSQRSRQMSSSKTIGIIGGGQLGQMMAISAIYMGHKVIALDPAADCPASRVAEIIVAPYNDVDALRQLADRCDVLTYEFENVDADGLDAVIKDGQLPQGTDLLRISQNRIFEKDFLSNKAQVTVAPYKVVTSSLDLADIDLSKNYVLKTATGGYDGHGQKVIRSEADLEAAYALADSADCVLEEFVNFDLEISVIVSGNGKEVTFFPVQENIHRNNILSKTIVPARISESLVDKAKAMAVRIAEQLNLSGTLCVEMFATDDDVIVNEIAPRPHNSGHYSIEACDFSQFDTHILGVLGAPLPVIKLHAPAVMLNVLGQHVEAAEQYVTENSSAHLHMYGKIEAKHNRKMGHVTLFSDVPDSVDELGEGIDF

SEQ ID NO: 5042 - protein, 154 aa, Streptococcus pneumoniae
MGSKSDWATMQKTAEVLDRFGVAYEKKVVSAHRTPDLMFKHAEEARSRGIKIIIAGAGGAAHLPGMVAAKTTLPVIGVPVKSRALSGVDSLYSIVQMPGGVPVATMAIGEAGATNAALFALRLLSVEDKSIADALANFAEEQGKIAEESSNELI

SEQ ID NO: 5043 - protein, 420 aa, Streptococcus pneumoniae
MKLLVVGSGGREHAIAKKLLESKDVEKVFVAPGNDGMTLDGLELVNISISEHSKLIDFAKTNDVAWTFIGPDDALAAGIVDDFNQAGLKAFGPTRAAAELEWSKDFAKEIMVKYGVPTAIYGTFSDFEEAKAYIEKHGAPIVVKADGLALGKGVVVAETVEQAVEAAHEMLLDNKFGDSGARVVIEEFLEGEEFSLFAFVNGDKFYIMPTAQDHKRAYDGDKGPNTGGMGAYAPVPHLPQSVVDTAVDTIVKPVLEGVIKEGRPYLGVLYAGLILTADGPKVIEFNARFGDPETQLILPRLTSDFAQNITDILDSKEPNITWTDKGVTLGVVVASKGYPLDYSKGVELPVKTDGDIITYYAGAKFAENSRALLSNGGRVYMLVTTADTVKEAQASIYQELSQQKIEGLFYRTDIGSKAIK

SEQ ID NO: 5044 - protein, 226 aa, Streptococcus pneumoniae
LASSKSENVPYIAVGTPYLTMISLAKSLDHSSSAAALVGPKALSPAWLKSSTMPAARASSGPIKVQATSLVFAKSINLECSEIEIFTNSKPSRVIPSFPGATKTFSTSFDSSNFLAIACSRPPEPTTSSFIPQPLLRIIYQHYIKKVRFNLVSVSILSQKRKETVFFPFIFLMSKMSHTCKDHSQAVFIRCFDGFLVTDRATGLDDGLNSCFGDFFHVIRKWEEGI

SEQ ID NO: 5045 - protein, 522 aa, Streptococcus pneumoniae
MIKKENIMTKRVLISVSDKAGIVEFAQELKKLGWEIISTGGTKVALDNAGVDTIAIDDVTGFPEMMDGRVKTLHPNIHGGLLARRDLDSHLEAAKDNKIELIDLVVVNLYPFKETILKPDVTYADAVENIDIGGPSMLRSAAKNHASVTVVVDPADYAVVLDELAANGETSYETRQRLAAKVFRHTAAYDALIAEYFTAQVGESKPEKLTLTYDLKQPMRYGENPQQDADFYQKALPTDYSIASAKQLNGKELSFNNIRDADAAIRIIRDFKDSPTVVALKHMNPCGIGQADDIETAWDYAYESDPVSIFGGIVVLNREVDAATAEKMHGVFLEIIIAPSYTDEALAILINKKKNLRILALPFNAQEASEVEAEYTGVVGGLLVQNQDVVKESPADWQVVTKRQPTETEATALEFAWKAIKYVKSNGIIVTNDHMTLGVGPGQTNRVASVRLAIDQAKDRLDGAVLASDAFFPFADNVEEIAKAGIKAIIQPGGSVRDQESIEAADKYGLTMVFTGVRHFRH

SEQ ID NO: 5046 - protein, 169 aa, Streptococcus pneumoniae
MLESKKTTRYVFYVYLMLLTWGILFKFETNPEFIAFFLAPRYINWIPFSEPLIVDGKIVFAEMLFNLIFFIPLGVCFPLIKTNLSSLRIVGTGFLISLLFECLQYILAIGITDITDLTLNTLGVCVGLLIYQIFIRVFKSQTRKWINILGMLSLGFAYLVLLLLHLIGV

SEQ ID NO: 5047 - protein, 115 aa, Streptococcus pneumoniae
ISKPTQTPSVFKVKSVISVIPIAKIYCKHSNNKLIKKPVPTILKLDKLVFIKGKQTPNGIKKIRLNNISAKTIFPSTISGSENGIQLIYLGAKKNAINSGFVSNLNKIPQVNNIR

SEQ ID NO: 5048 - protein, 181 aa, Streptococcus pneumoniae
MKKIAVFASGNGSNFQVIAEEFPVEFVFSDHRDAYVLERAKQLGVLSYAFELKEFESKTDYEAALVELLEEHQIDLVCLAGYIKIVGPTLLSAYEGRIVNIHPAYLPEFPGAHGIEDAWNAGVGQSGVTIHWVDSGVDTGQVIKQVRVPRLADDTIDRFEARIHEAEYRLYPEVVKALFTD

SEQ ID NO: 5049 - protein, 340 aa, Streptococcus pneumoniae
MTNKNAYAQSGVDVEAGYEVVERIKKHVARTERAGVMGALGGFGGMFDLSKTGVKEPVLISGTDGVGTKLMLAIKYDKHDTIGQDCVAMCVNDIIAAGAEPLYFLDYVATGKNEPAKLEQVVAGVAEGCVQAGAALIGGETAEMPGMYGEDDYDLAGFAVGVAEKSQIIDGSKVVEGDVLLGLASSGIHSNGYSLVRRVFADYTGEEVLPELEGKKLKEVLLEPTRIYVKAVLPLIKEELVNGIAHITGGGFIENVPRMFADDLAAEIDESKVPVLPIFKALEKYGQIKHEEMFEIFNMGVGLMLAVSPENVERVKELLDEAVYEIGRIVKKENESVIIK

SEQ ID NO: 5050 - protein, 480 aa, Streptococcus pneumoniae
MTYEVKSLNEECGVFGIWGHPDAAKLTYFGLHSLQHRGQEGAGILSNDQGQLKRHRDMGLLSEVFRNPANLDKLTGAGAIGHVRYATAGEASVDNIQPFLFRFHDMQFGLAHNGNLTNAASLKKELEQRGAIFSATSDSEILAHLIRRSHNPSLMGKIKEALSLVKGGFAYILLFENKLIAALDPNGFRPLSIGKMANGAVVVSSETCAFEVIGAEWIRDLKPGEIVIIDDEGIQYDSYTDDTQLAICSMEYIYFARPDSNIHGVNVHTARKRMGAQLAREFKHEADIVVGVPNSSLSAAMGFAEESGLPNEMGLIKNQYTQRTFIQPTQELREQGVRMKLSAVSGVVKGKRVVMVDDSIVRGTTSRRIVQLLKEAGATEVHVAIGSPALAYPCFYGIDIQTRQELIAANHTVEETRQIIGADSLTYLSIDSLIESIGIETDAPNGGLCVAYFDGDYPTPLYDYEEDYRRSLEEKTSFYK

SEQ ID NO: 5051 - protein, 1242 aa, Streptococcus pneumoniae
LMDKRIFVEKKADFQVKSESLVRELQHNLGLSSLKSIRIVQVYDVFDLAEDLFAPAEKHIFSEQGTDHVLDEVSVQADLANYAFFAIESLPGQFDQRAASSQEALLLLGSSSDVTVNTAQLYLVNKDIDATELEAVKNYLLNPVDSRFKDITTGIAKQEFSESDKTIPKLTFFESYTAEDFARYKAEQGMAMEVDDLLFIQDYFKSIGRVPTETELKVLDTYWSDHCRHTTFETELKHIDFSASKFQKQLQSTYDKYIAMREELGRSEKPQTLMDMATIFGRYERANGRLDDMEVSDEINACSVEIEVDVDGVKEPWLLMFKNETHNHPTEIEPFGGAATCIGGAIRDPLSGRSYVYQAMRISGAGDITAPISETRAGKLPQQVISKTAAHGYSSYGNQIGLATTYVREYFHPGFVAKRMELGAVVGAAPKGNVVREKPEAGDVIILLGGKTGRDGVGGATGSSKVQTVESVETAGAEVQKGNAIEERKIQRLFRNGNVTRLIKKSNDFGAGGVCVAIGELADGLEIDLNKVPLKYQGLNGTEIAISESQERMAVVVRPEDVDAFVAECNKENIDAVVVATVTEKPNLVMHWNGETIVDLERRFLDTNGVRVVVDAKVVDKDVKLPEERQTSAETLESDTLTVLSDLNHASQKGLQTVFDCSVGRSTVNHPLGGRYQLTPTEASVQKLPVQHGVTHTASVIAQGFNPYVAEWSPYHGAAYAVIEATARLVAAGANWSKARFSYQEYFERMDKQAERFGQPVAALLGSIEAQIQLGLPSIGGKDSMSGTFEELTVPPTLVAFGVTTADSRKVLSPEFKAVGENIYYIPGQALSAEIDFDLIKKNFAQFEASQADHKVTSASAVKYGGVVESLALATFGNYIGAEVTLPELKTALTAQLGGFVFTSPEEIAGVEKIGQTKADFTLTVNGVKLDGHKLDSAFQGTLEEVYPTEFTQAKELEEVPAVASDVVIKAKEKVEKPVVYIPVFPGTNSEYDSAKAFEKEGAEVNLVPFVTLNEEAIVKSVETMVDNIDKTNILFFAGGFSAADEPDGSAKFIVNILLNEKVRVAIDSFIARGGLIIGICNGFQALVKSGLLPYGNFEDANSTSPTLFYNDANQHVAKMVETRIANTNSPWLAGVQVGDIHAIPVSHGEGKFVVTAEEFAELRDNGQIFSQYVDFNGKPSMDSKYNPNGSVHAIEGITSKNGQIIGKMGHSERYEDGLFQNIPGNKDQHLFASAVKHFTGK

SEQ ID NO: 5052 - protein, 44 aa, Streptococcus pneumoniae
LWVSFLNMRSQGSLTPSTSTSISTEQALISSETSISSNRPLARS

SEQ ID NO: 5053 - protein, 203 aa, Streptococcus pneumoniae
LIIQKLKESKISDQSFSTSPLTQVINSPSLTSGATHFVEKLSDTEQLNKKVKIIPLEVVLRNYTAGSFSKRFGVDEGIALETPIVEFYYKNDDLDDPFINDEHVKFLQIAGDQQIAYLKEETRRINELLKVWFTEIGLKLIDFKLEFGFDKDGKIILADEFSPDNCRLWDADGNHMDKDVFRRGLGELTDVYEIVWEKLQELK

SEQ ID NO: 5054 - protein, 123 aa, Streptococcus pneumoniae
LDIEVLGGGGGGGGGGGGGGAFCGGGRLTRVKKGDVFDSNEAMSTKIKQGGTTYDIAIPSEYMINKMKDEDLLVPLDYSKIEGIENIGPEFLNQSFDPGNKFSIPYFWGDSLCGETFRHGTTQ

SEQ ID NO: 5055 - protein, 430 aa, Streptococcus pneumoniae; identical to SEQ ID NO: 3876

SEQ ID NO: 5056 - protein, 85 aa, Streptococcus pneumoniae
LFHMNLSNDGFVAFHYRSYGTFFLHKNRLHNIYSGFTHYKYYRAFFLHKNRLHNIYRGFTHYKYYRAQNPLFTKQGIFLLSLLLF

SEQ ID NO: 5057 - protein, 165 aa, Streptococcus pneumoniae
MLKSEKQSRYQMLNEELSFLLEGETNVLANLSNASALIKSRFPNTVFAGFYLFDGKELVLGPFQGGVSCIRIALGKGVCGEAAHFQETVIVGDVTTYLNYISCDSLAKSEIVVPMMKNGQLLGVLDLDSSEIEDYDAMDRDYLEQFVAILLEKTAWDFTMFEEKS

SEQ ID NO: 5058 - protein, 551 aa, Streptococcus pneumoniae
MYQALYRKYRSQNFSQLVGQEVVAKTLKQAVEQEKISHAYLFSGPRGTGKTSVAKIFAKAMNCPNQVGGEPCNNCYICQAVTDGSLEDVIEMDAASNNGVDEIREIRDKSTYAPSLARYKVYIIDEVHMLSTGAFNALLKTLEEPTQNVVFILATTELHKIPATILSRVQRFEFKSIKTQDIKEHIHYILEKENISSEPEAVEIIARRAEGGMRDALSILDQALSLTQGNELTTAISEEITGTISLSALDDYVAALSQQDVPKALSCLNLLFDNGKSMTRFVTDLLHYLRDLLIVQTGGENTHHSSVFVENLALPQKNLFEMIRLATVNLADIKSSLQPKIYAEMMTVRLAEIKPEPALSGAVENEIATLRQEVARLKQELSNAGAVPKQVAPAPSRPATGKTVYRVDRNKVQSILQEAVENPDLARQNLIRLQNAWGEVIESLGGPDKALLVGSQPVAANEHHAILAFESNFNAGQTMKRDNLNTMFGNILSQAAGFSPEILAISMEEWKEVRAAFSAKAKSSQTEKEVEESLIPEGFEFLADKVKVEED

SEQ ID NO: 5059 - protein, 64 aa, Streptococcus pneumoniae
MNKQQFIIMALFTAAETYFFNEAWMTGRYIMAAFWAILLFRNFRVSYVMGKIVDVIDQHFNRKD

SEQ ID NO: 5060 - protein, 256 aa, Streptococcus pneumoniae
MSVLEITDLHVEIEGKEILKGVNLTLKTGEIAAIMGPNGTGKSTLSAAIMGNPNYEVTKGEVLFDGVNILELEVDERARMGLFLAMQYPSEIPGITNAEFLRAAMNAGKEDDEKISVREFITKLDEKMELLNMKEEMAERYLNEGFSGGEKKRNEILQLLMLEPTFALLDEIDSGLDIDALKVVSKGVNAMRGEGFGAMIITHYQRLLNYITPDVVHVMMEGRVVLSGGPELAARLEREGYAKLAEELGYDYKEEL

SEQ ID NO: 5061 - protein, 420 aa, Streptococcus pneumoniae
MTRENIKLFSEMHAEPSWLADLRQKAFDKIETLELPVIERVKFHRWNLGDGTITENEPSANVPDFTALDHHLKLVQVGTQTVFEQTPVELAEQGVVFTDFHSALEEIPELIEEFFMSSVKYDDDKLAAYHTAYFNSGAVLYIPDNVEITEPIEGIFYQDSDSNVPFNKHIMIIAGKNSKISYLERLESRGEGSDKVTANITVEVIARSGAQVKFAAIDRLGENVTAYISRRGKLGNDASIDWAIGVMNEGNVVADFDSDLIGNGSHADLKVVALSSGRQVQGIDTRVTNYGCNSIGNILQHGVILEKATLTFNGIGHIIKGAKGADAQQESRVLMLSDQARSDANPILLIDENDVTAGHAASIGQVDPEDMYYLMSRGLDKATAERLVVRGFLGSVIVEIPVKEVRDEMIATIEEKLSKR

SEQ ID NO: 5062 - protein, 408 aa, Streptococcus pneumoniae
MLDVEAIRKDFPILDQIVNDEPLVYLDNAATTQKPLVVLKAINSYYEQDNANVHRGVHTLAERATASYEAARETIRKFINAGSTKEVLFTRGTTTSLNWVARFAEEILAEGDRVLISVMEHHSNIIPWQEACRKTGAELVYVYLKDGALDMEDLRAKLTDKVKFVSLAHASNVLGVVNPIKEITQLAHQVGAIMVVDGAQSTPHMKIDVQDLDLDFFAFSGHKMAGPTGIGVLYGKEKYLEQMSPVEFGGEMIDFVYEQFASWKELPWKFEAGTPNMAGAIGLATAVDYLEKIGMDAVEAHEQELIAYVYPKLQAIEGLTIYGSQDLAQRSGVIAFNLGDLHPHDLATALDYEGVAVRAGHHCAQPLLQYLEVPATARASFYIYNTKADCDKLVDALQKTKEFFNGTF

SEQ ID NO: 5063 - protein, 156 aa, Streptococcus pneumoniae
MPYKRQRSFSMALSKLDSLYMAVVADHSKNPHHQGKLEDAEQTSLNNPTCGDVINLSVKFDAEDRLEDIAFLNSGCTISTASASMMTDAVLGKTKQEILELATIFSEMVQGQKDERQGQLGDAAFLSGVAKFPQRIKCATLAWNALKKTIENQEKQ

SEQ ID NO: 5064 - protein, 470 aa, Streptococcus pneumoniae
MAEERVEPKPIDLGEYKFGFHDDVEPVLSTGKGLNEGVIRELSAAKGEPEWMLEFRLKSYETFKKMPMQTWGADLSEIDFDDLIYYQKPSDKPARSWDDVPEKIKETFERIGIPEAERAYLAGASAQYESEVVYHNMKEEFQKLGIIFTDTDSALKEYPDLFKQYFAKLVPPTDNKLAALNSAVWSGGTFIYVPKGVKVDIPLQTYFRINNENIGQFERTLIIVDEGASVHYVEGCTAPTYSSNSLHAAIVEIFALDGAYMRYTTIQNWSDNVYNLVTKRAKAQKDATVEWIDGNLGAKTTMKYPSVYLDGEGARGTMLSIAFANAGQHQDTGAKMIHNAPHTSSSIVSKSIAKGGGKVDYRGQVTFNKNSKKSVSHIECDTIIMDDLSASDTIPFNEIHNSQVALEHEAKVSKISEEQLYYLMSRGLSESEATEMIVMGFVEPFTKELPMEYAVELNRLISYEMEGSVG

SEQ ID NO: 5065 - protein, 64 aa, Streptococcus pneumoniae
VNLILKIKEQTRKLAAGCSKHCFEVVDETDEVSNHTYGKAMLTWLEEIFEEYKIKFYPTDPSIS

SEQ ID NO: 5066 - protein, 61 aa, Streptococcus pneumoniae
NLILYSSKISSSHVSIALPYVWLLTSSVSSTTSKQCFEQPAASFLVCSLILSIRFTQNQGF

SEQ ID NO: 5067 - protein, 413 aa, Streptococcus pneumoniae
MKKIFLTLLTVSLLGGASTAVAQDFTIAAKHAIAVEANTGKILYEKDATQPVEIASITKLITVYLVYEALENGSITLSTPVDISDYPYQLTTNSEASNIPMEARNYTVEELLEATLVSSANSAAIALAEKIAGSEKDFVDMMRAKLLEWGIQDATVVNTTGLNNETLGDNIYPGSKKDEENKLSAYDVAIVARNLIKKYPQVLEITKKPSSTFAGMTITSTNYMLEGMPAYRGGFDGLKTGTTDKAGESFVGTTVEKGMRVITVVLNADHQDNNPYARFTATSSLMDYISSTFTLRKIVQQGDAYQDSKAPVQDGKEDTVTAVAPEDIYLIEQIGNQSSQSVQFTPDSKAIPAPLEAGTVVGHLTYKDKDLIGQGYITTERPSFEMVADKKIEKAFFLKVWWNQFVRFVNEKL

SEQ ID NO: 5068 - protein, 369 aa, Streptococcus pneumoniae
MFRRNKLFFCTTEILLLTIIFYLWRQMGSLINPFVSVLNTIMIPFLLGGFLYYLTNPIVTFLNKVCKLNRLLGILITLCTLVWGMVIGVVYLLPILINQLSSLIISSQTIYSRVQDLIIDLSNYPALQNLDVEATIQQLNLSYVDILQNILNSVSNSVGSVLSALISTVLILIMTPVFLVYFLLDGHKFLPMLERTILKRDRLHIAGLLKNLNATIARYISGVSIDAIIIGCLAYIGYSIIGLKYALVFAIFSGVANLIPYVGPSIGLIPMIIANIFTDPHRLLIAVIYMLVVQQVDGNILYPRIVGSVMKVHPITILVLLLLSSNIYGVVGMIVAVPTYSILKEISKFLSRLYENHKIMKERERELAK

SEQ ID NO: 5069 - protein, 72 aa, Streptococcus pneumoniae
TRAIQIGSRLLVFRQLERKKCYFLQLYLTERLRRHTSRKICLIMPVESVTTPKDNKTIIPYLTQKCKKKSHT

SEQ ID NO: 5070 - protein, 66 aa, Streptococcus pneumoniae
FNSSKISCLRSVFNTESPPVIVYTIHSIILSFEVKHFLSFSFKIYHFFLFLEFLLQDKSLYGRLFE

SEQ ID NO: 5071 - protein, 246 aa, Streptococcus pneumoniae
VLKTERKQLILEELNQHHVVSLEKLVSLLETSESTVRRDLDELEAENKLRRVHGGAELPHSLQEEETIQEKSVKNLQEKKLLAQKAASLIKEKDVIFIDAGTTTAFLIHELVNKNVTVVTNSIHHAAQLVEKQIPTVMVGGNVKTATDASIGGVALNQINQLHFDRAFIGMNGVDDGYYTTPDMEEGAVKRAILENAKQTYVLVDSSKIGQTCFAKVAPLKRAIVITSQGHELLQVIKEKTEVIEV

SEQ ID NO: 5072 - protein, 303 aa, Streptococcus pneumoniae
  UNSURE (17): Xaa at each above location is unknown.
MIYTVTLNPSIDYIVRXDQVKVGSVNRMDSDDKFAGEKGINVSRVLKRLNISNTATGFIGGFTGKFITDTLAEEEIETRFVQVAEDTRINVKIKADQETEINGTGPTVEPVKLEELKAILSSLTAEDTVVFAGSSAKNLGNVIYKDLISLTRQTGAQVVCDFEGQTLIDSLDYQPLLVKPNNHELGAIFGVKLESLDEIEKYARELLAKGAQNVIISMAGDGALLVTSEGAYFAKPIKGTVKNSVGAGDSMVAGFTGEFVKSKDAVEAFKWGVACGTATTFSDDLATAEFIKETYGKVEVEKR

SEQ ID NO: 5073 - protein, 75 aa, Streptococcus pneumoniae
LNFHRFSTSTFPYVSLINSAVAKSSEKVVAVPQATPHLKASTASFDLTNSPVNPATIESPAPTEFLTVPLIGLAK

SEQ ID NO: 5074 - protein, 650 aa, Streptococcus pneumoniae
MKIQDLLRKDVMLLDLQATEKTAVIEEMIKSLTGHGYVTDFETFKEGILAREALTSTGLGDGIAMPHSKNAAVKEATVLFAKSNKGVDYESLDGQATDLFFMIAAPEGANDTHLAALTELSQYLMKDGFADKLRQATSADQVIELFDQASEKTEELVQAPANDSGDFIVAVTACTTGIAHTYMAQEALQKVPAEMGVGIKVETNGASGVGNQLTAEDIRKAKAIIIAANKAVEMDRFDGKPLINRPVADGIRKTEELINLAISGDAEVYRAANGAKVATASNEKQSLGGAFYKHLMSGVSQMLPFVIGGGIMIALAFLIDGALSVPNENLGNLGSYHELASMFMKIGGAAFGLMLPVFAGYVAYSIAEKPGLVAGFVAGAIAKEGFAFGNIPYAAGGEATSTLAGVSSGFLGALVGGFIAGALVLAIKKYVKVPRSLEGAKSILLLPLLGTILTGFVMLAVNIPMAAINTAMNDFLGGLGGGSAVLLGIVLGGMMAVDMGGPVNKAAYVFGTGTLAATVSSGGSVAMAAVMAGGMVPPLAIFVATLLFKDKFTKEERNSGLTNIIMGLSFITEGAIPFGAADPARAIPSFILGSAVAGGLVGLTGIKLMAPHGGIFVIALTSNALLYLVSVLVGAIVSGVVYGYLRKPQA

SEQ ID NO: 5075 - protein, 737 aa, Streptococcus pneumoniae
MANKNTSTTRRRPSKAELERKEAIQRMLISLGIAILLIFAAFKLGAAGITLYNLIRLLVGSLAYLAIFGLLIYLFFFKWIRKQEGLLSGFFTIFAGLLLIFEAYLVWKYGLDKSVLKGTMAQVVTDLTGFRTTSFAGGGLIGVALYIPTAFLFSNIGTYFIGSILILVGSLLVSPWSVYDIAEFFSRGFAKWWEGHERRKEERFVKQEEKARQKAEKEARLEQEETEKALLDLPPADMETGEILTEEAVQNLPPIPEEKWVEPEIILPQAELKFPEQEDDSDDQDVQVDFSAKEALEYKLPSLQLFAPDKPKDQSKEKKIVRENIKILEATFASFGIKVTVERAEIGPSVTKYEVKPAVGVRVNRISNLSDDLALALAAKDVRIEAPIPGKSLIGIEVPNSDIATVSFRELWEQSQTKAENFLEIPLGKAVNGTARAFDLSKMPHLLVAGSTGSGKSVAVNGIIASILMKARPDQVKFMMVDPKMVELSVYNDIPHLLIPVVTNPRKASKALQKVVDEMENRYELFAKVGVRNIAGFNAKVEEFNSQSEYKQIPLPFIVVIVDELADLMMVASKEVEDAIIRLGQKARAAGIHMILATQRPSVDVISGLIKANVPSRVAFAVSSGTDSRTILDENGAEKLLGRGDMLFKPINENHPVRLQGSFISDDDVERIVSFIKTQADADYDESFDPGEVSENEGEFSDGDAGGDPLFEEAKSLVIEIQKAVGIHDSASFVSWI

SEQ ID NO: 5076 - protein, 83 aa, Streptococcus pneumoniae
QRKLFKIFHLFQKKSGWNQKSSCLKLNLNSLNRKMTQMTKMFRSIFQPKKPLNTNFQAYNSLHQINQKISLKRRKLSEKISKS

SEQ ID NO: 5077 - protein, 94 aa, Streptococcus pneumoniae
ASSRLRQMQTTMRVLIQVRFLKMKENFRMEMLVVIRFLKKLSLWLSKYRKQLESMIQRRLSVGFNRATRLMEELEMAGVIGPAEGTKPRKVLQQ

SEQ ID NO: 5078 - protein, 71 aa, Streptococcus pneumoniae
RYQAKKSIAAIKNSFFPRLEGAILLAIDYFYTLRKSLQTTSALPCRIYVTDFVMSYLQPQNSVLSSLRLAS

SEQ ID NO: 5079 - protein, 219 aa, Streptococcus pneumoniae
MDFLKFLKPPAYRFQGLLDRAWSSPNYQSKSCFSRFLKSLVLLYHETEPATRKGNFSFFKIFLKKQSIINHNQRRECMSNYRRTSKPKTEHIKKGFTVFQKTITTIGSILGLITAGITIMNALDNNNKNTKKEPTTSQTTTFVKEIQKESPQENTTPNKENNTSQEKTQQEETPKSSVKEEKKEDQKTATQDSTTPATSKPATENEKQPNTPTSENNTQ

SEQ ID NO: 5080 - protein, 400 aa, Streptococcus pneumoniae
LSQAPFHDTIELVILESVRNMIYFDNSATTRPYPEALETYMQVASKILGNPSSLHRLGDQATRILDASRQQIADLIGKKSDEIFFTSGGTEGDNWIIKGVAFEKAQFGKHIIVSAIEHPAVKESALWLKAQGFEVDFAPVDNKGFVDVEALEDLIRPDTTLVSIMAVNNEIGSVQPIEAISKLLADKPTISFHVDAVQALAKIPTEKYLTERVDFATFSGHKFHGIRGVGFIYIKSGKKITPLLTGGGQERDYRSTTENVAGIAATAKALRLSMEKLDIFRSKTGQMKAVIRQALLDYPDIFVFSDEEDFAPHILTFGIKGVRGEVIVHAFEDYDIFISTTSACSSKAGKPAGTLIAMGVDKDKAQSAVRLSLDLENDMSQVEQFLTKLKLIYNQTRKVR

SEQ ID NO: 5081 - protein, 404 aa, Streptococcus pneumoniae
MQYSEIMIRYGELSTKGKNRMRFINKLRNNISDVLSIYPQVKVTADRDRAHAYLNGADYTAVAESLKQVFGIQNFSPVYKVEKSVEVLKSAVQEIMQDIYKEGMTFKISSKRSDHTFELDSRELNQTLGRAVFEAIPNVQAQMKSPDINLQVEIREEAAYLSYETVRGAGGLPVGTSGKGMLMLSGGIDSPVAGYLALKRGVDIEAVHFASPPYTSPGALKKAQDLTRKLTKFGGNIQFIEVPFTEIQEEIKAKAPEAYLMTLTRRFMMRITDRIREVRNGLVIINGESLGQVASQTLESMKAINAVTNTPIIRPVVTMDKLEIIDIAQEIDTFDISIQPFEDCCTIFAPDRPKTNPKIKNAEQYEARMDVEGLVERAVAGIMITEITPQAEKDEVDDLIDNLL

SEQ ID NO: 5082 - protein, 209 aa, Streptococcus pneumoniae
LNIESFLTMNQSYFYLKMKEHKLKVHYTGKERRVRILLPKDYEKDTDRSYPVVYFHDGQNVFNSKESFIGHSWKIIPAIKRNPDISRMIVVAIDNDGMGRMNEYAAWKFQESPIPGQQFGGKGVEYAEFVMEVVKPFIDETYRTKADCQHTAMIGSSLGGNIPSLSVWNTKTKLVAWAFFHLQTGSTKKPLTAISSARNYRLTSASSSM

SEQ ID NO: 5083 - protein, 115 aa, Streptococcus pneumoniae
LEYQDQIGCLGVFSSANWLHQEAFNRYIECQKLSPDQRIFIYVGTEEADDTDKTLMDGNIKQAYIDSSLCYYHDLIAGGVHLDNLVLKVQSGAIHSEIPWSENLPDCLRFFAEKW

SEQ ID NO: 5084 - protein, 111 aa, Streptococcus pneumoniae
MHIEHLSHWSGHLNREMYLNRYGHGGIPVVVFASSGGSHNEYYDFGMIDACASFIEEGRVQFFTLSSVDSESWLATWKNAHDQAEMHRAYERYVIEEAILLSSTRQVGLMA

SEQ ID NO: 5085 - protein, 143 aa, Streptococcus pneumoniae
LFTPPFPVMGDIMSPFSKSGWNLFLVKGFFELVKGWQTILFPGSKPRTQHNLCLTVTVNKPAVVLVPNIIYWRVLVNSIIVVVITDKETCVVNTTESNHFGKDIWMLEEEIECMIGSHRATCRHHAIKPTCLVLDKRMASSIT

SEQ ID NO: 5086 - protein, 60 aa, Streptococcus pneumoniae
MMTTGCSMGAYHALNFFLQHPDVFTKVIALSGVYDARFFVGDYYNDDAIYQNSPVDYIWN

SEQ ID NO: 5087 - protein, 388 aa, Streptococcus pneumoniae
MNYLVISPYYPQNFQQFTIELANKGITALGIGQESYEQLDEPLRNSLTEYFRVDNLENIDEVKRAVAFLFYKHGPIDRIESHNEYWLELDATLREQFNVFGAKPEDLKKTKYKSEMKKLFKKAGVPVVPGAVIKTEADVDQAVKEIGLPMIAKPDNGVRAAATFKLETEDDINHFKQEWDHSTLYFFEKFVTSSEICTFDGLVDKDGKIVFSTTFDYAYTPLDLMIYKMDNSYYVLKDMDPKLRKYGEAIVKEFGMKERFFHIEFFREGDDYITIEYNNRPAGGFTIDVYNFAHSLDLYRGYAAIVAGEEFPASDFETQYCLATSRRANAHYVYSEEDLLAKYSQQFKVKKVMPAAFAELQGDYLYMLTTPSRQEMEQMIADFGQRQE

SEQ ID NO: 5088 - protein, 497 aa, Streptococcus pneumoniae
MITGELKNKIDQLWEILWTEGNANPLTNIEQLTYLLFMKDLDSVELGRESDAEFLGIPYEGVFPKDKPEYRWSTFKNIGDAQEVYRLMTQEIFPFIKNLKGDTDDTAFSRYMREAIFQINKPATLQKAISILDVFPTRGLDVDFDNDKQSITDIGDIYEYLLSKLSTAGKNGQFRTPRHIIDMMVELMQPTIKDIISDPAMGSAGFLVSASRYLKRKKDEWETNTDNINHFHNQMFHGNDTDTTMLRLGAMNMMLHGVENPQISYLDSLSQDNEEADKYTLVLANPPFKGSLDYNSTSNDLLATVKTKKTELLFLSLFLRTLKPGGRAAVIVPDGVLFGSSKAHKGIRQEIVENHKLDAVISMPSGVFKPYAGVSTAILIFTKTGNGGTDKVWFYDMKADGLSLDDKRQPIRDNDIPDIIERFHHLEKEAERQRTDQSFFVPVAEIKENDYDLSINKYKEIEYEKVEYEPTEVILKKINDLEKEIQAGLAELEKLLK

SEQ ID NO: 5089 - protein, 373 aa, Streptococcus pneumoniae
MKKVKLGEVLSLKKGKKATVLAEQTTLSQRYIQIDDLRNNNNLKFTESLNMTEALPDDILIAWDGANAGTVGYGLSGAVGSTITVLKKNERYKEKIISDYLGVFLESKSQYLRDHSTGATIPHLNKNILLDLQLELLGIEEQENIICILNTIKRLITKRKFQLDELNLLVKSRFNEMFGENKIFESIDNLFDIIDGDRGKNYPKSDELFSEEYCLFLNTKNVTKNGFSFDTKQFITKTKDKLLRKGKLERYDIVLTTRGTVGNVAYYDELIKYKHLRINSGMVILRPKTPNLNQKFIIHVLRNNNYSRVISGSAQPQLPITKLKKILLPLPPLALQNEFADFVVQVDKSQLAIQKSLEELETLKKSLMQEYFG

SEQ ID NO: 5090 - protein, 78 aa, Streptococcus pneumoniae
MVVKTRKQGNSITITIPSEFNIPSGVKYEAKLLQSGEIIFTPEELGQQVSYVSDDAFDLNLDKIFDEYDDVFKALVEK

SEQ ID NO: 5091 - protein, 137 aa, Streptococcus pneumoniae
MTIYLTEKQIEKINALAIQRYSPNEKIQTVSSSALNMIVNLPEQFVFGKSLYPTIFDKATILFVQLIKKHVFANANKRTAFFVLVKFLQLNGYRFSVTVEEAVKMCVTIAVEALTDEKMTSYSKWVSEHSVREKVKK

SEQ ID NO: 5092 - protein, 275 aa, Streptococcus pneumoniae
LQLFITAKQVEGCSSKTIRYYQRTIENLFNAIKESVTQLTTDDLRSYLANYQSEKDCSKANLDNIRRILSSFFAWLEQEEYIIKNPIRRIKKIKTEQNVKETYTDEHLEIMRDNCENLRDLAIIDLLASTGMRVGELVQLNRSDIDFENRECVVFGKGKKERPVYFDARTKIHLRNYLNDRKDSHPALFVTLVGKAQRLGIAGVEIRLRKLGDKLGIQKVHPHKFRRTLATKAIDKGMPIEQVQKLLGHSKIDTTLAYAMVNQNNVKHSHQKFIS

SEQ ID NO: 5093 - protein, 368 aa, Streptococcus pneumoniae
MKKVKLGQVATFINGYAFKPQDWSSEGKEIIRIQNLTKTSKGINYYSGTIDKKYIVEAGDILISWSGTLGVFQWCGRSAVLNQHIFKVVFDKIDIDKSYFKYVVEKGLQDAVKHTHGSTMKHLTKKYFDNIIVPYTNLGEQQRIASELDLLSKLILRRQEQLEELNLLVKSRFNEMFGENKIFESIDNLFDIIDGDRGKNYPKSDELFSEEYCLFLNTKNVTKNGFSFDTKQFITKTKDKLLRKGKLERYDIVLTTRGTVGNVAYYDELIKYKHLRINSGMVILRPKTPNLNQKFIIHVLRNNNYSRVISGSAQPQLPITKLKKILLPLPPLALQNEFADFVVQVDKSQFACEIAIKVWRNSLKFSII

SEQ ID NO: 5094 - protein, 1116 aa, Streptococcus pneumoniae
MGNFSFLLKNDEYESFSKPCIEAENMIATSTVATAFMARRALEQAVHWIYSHDSYLEAPYRATLSSLVWDDDFRDIVDSELHKQIVLLIRWGNHAAHGGEIKEREAILALHHLYQFVNFIDYCYSNEFVERYFDEKCLPLSANIKYRETPQSMIKLQDSLPELPDFHEQMAAQSVEVQETYTEKRETAAQRQDVPFHIDQLSEAETRKLFIDIDLRLAGWIFEENCRVEIAVDGLKHGSGIGYCDYVLYGKNGKILAIVEAKKASVNPEVGEVQVKEYAEALEKHIGYQPICFITNGLKHYILDGPNRRQIAGFYSQEELQLVMDRRHLQKPLEDISSKIRDDISGRHYQKHAIASVCEAFSNHRRQALLVMATGAGKTRTAVSLVDILSRHNWVKNVLFLADRTSLVKQAYDSFRKLLPDLSVCNFLEDKEGAQSSRMVFSTYPTMIGAISGQEEVNQRPFTVGHFDLIIIDESHRSIYQKYKSIFDYFDARIVGLTATPRQDLDKNTYGFFNLENGVPTYAYDLEEAVKDGYLVAYHSIETKLKLPTDGLHYDDLSEEEKEHFDSKFEDDSCEKDIDGSVFNSFVFNKSTVEIVLNELMTRGIQTASGDEIGKTIIFAKNHDHAEYIRGIFNNRYPEKGSDYAQVIDYSIKHYQTLIDDFKIKEKYPQIAISVDMLDTGIDVPEVVNLVFFKKVRSKTKFWQMIGRGTRLCKDLFGPEQDKENFLVFDYGDNFDYFRADPRDGEGRHIVSLTQRLFNIKVDLIRELQGLQYQEDQFARAYRQQLVSELQGRIESLNELDFRVRMVLDTVYSYRKLESWQNLTAVTSETIQKNLSPLLFDEDKEDEMARRFDLWLLHIQLGQLTAKSSTVHISQVMKTARALSAIGNIPQVFEQAEIIRKVQEPEFWKEVNLSDLEKIRLAIRDLLQFLDKTDRKPYYVNFEDRILSTVHETTAFLQVNDLRSYNEKVEHYLKTHLDEESISKLYHNKKLTSDDMLALEKLLWEKLGSKADYQSHYENKAIPRLVREIIGLDRESANRIFSKFLSDENLNARQISFVKLIVDYIVENGFLETKVLTQEPFKSYGSVQLLFQHQLPVLRNIVQIIELINNRAGEAA

SEQ ID NO: 5095 - protein, 156 aa, Streptococcus pneumoniae
MNKSEHRHQLIRALITKNKIHTQAELQALLAENDIQVTQATLSRDIKNMNLSKVREEDSAYYVLNNGSISKWEKRLELYMEDALVWMRPVQHQVLLKTLPGLAQSFGSIIDTLSFPDAIATLCGNDVCLIICEDADTAQKCFEELKKFAPPFFFEE

SEQ ID NO: 5096 - protein, 757 aa, Streptococcus pneumoniae
MRFNQYSYINFPKENVLSELKKCGFDLQNTANHKDSLETFLRRFFFTYQDTNYPLSILAADKKTDLLTFFQSEDELTADIFYTVAFQLLGFSYLVDFEDSDVFRKETGFPIIYGDLIENLYQLLNTRTKKGNTLIDQLVSDGLIPEDNDYHYFNGKSLATFSNQDVIREVVYVESRVDTDQKGLSDLVKVSIIRPRFDGKIPAIMTASPYHQGTNDKASDKALYKMEGELEVKLPHKIELEKPQLNLVQPQGKAELIAEAEEKLTHINSSYTLNDYFLPRGFANLYVSGVGTKDSTGFMTNGDYQQIEAYKNVIDWLNGRCRAFTDHTRQRQVKADWSNGKVATTGLSYLGTMSNGLATTGVDGLEVIIAEAGISSWYNYYRENGLVTSPGGYPGEDFDSLAELTYSRNLLAGDYIRGNEAHQADLEKVKAQLDRKTGDYNQFWHDRNYLLNAHKVKAEVVFTHGSQDWNVKPLHVYQMFHALPTHIHKHLFFHNGAHVYMNNWQSIDFRESINALLTKKLLGQETDFQLPTVIWQDNTAPQTWLSLDNFGGQENCETFSLGQEEQAIQNQYPDKDFERYGKTYQTFNTELYQGKANQITINLPVTKDLHLNGRAQLNLRIKSSTNKGLLSAQLLEFGQKKYLQPYPAILSARTIDNGRYHMLENLCELPFRPEAQRVVTKGYLNLQNRNDLLLVEDITADEWMDVQFELQPTIYKLKEGDTLRLVLYTTDFEITIRDNTDYHLTVDLAQSMLTLPC

SEQ ID NO: 5097 - protein, 1033 aa, Streptococcus pneumoniae
LIAQLDTKTVYSFMESVISIEKYVRAAKEYGYTHLAMMDIDNLYGAFDFLEITKKYGIHPLLGLEMTVFVDDQGVNLRFLALSSVGYQQLMKLSTAKMQGEKTWSVLSQYLEDIAVIVPYFDRVESLELGCDYYIGVYPETLASEFHHPILPLYRVNAFESRDREVLQVLTAIKENLPLREVPLRSRQDVFISASSLEKLFQERFPQALDNLEKLISGISYDLDTSLKLPRFNPARPAVEELRERAELGLVQKGLTSKEYQDRLDQELSVIHDMGFDDYFLVVWDLLRFGRSNGYYMGMGRGSAVGSLVSYALDITGIDPVEKNLIFERFLNRERYTMPDIDIDIPDIYRPDFIRYVGNKYGSKHAAQIVTFSTFGAKQALRDVLKRFGVPEYELSAITKKISFRDNLKSAYEGNLQFRQQINSKLEYQKAFEIACKIEGYPRQTSVHAAGVVISDQDLTNYIPLKYGDEIPLTQYDAHGVEASGLLKMDFLGLRNLTFVQKMQELLAEIEGIHLKIEEIDLEDKETLDLFASGNTKGIFQFEQPGAIRLLKRVQPVCFEDVVATTSLNRPGASDYINNFVARKHGQEEVTVLDPVLEDILAPTYGIMLYQEQVMQVAQRFAGFSLGKADILRRAMGKKDASAMHEMRASFIQGSLEAGHTVEKAEQVFDVMEKFAGYGFNRSHAYAYSALAFQLAYFKTHYPAIFYQIMLNSANSDYLIDALEAGFEVAPLSINTIPYHDKIANKAIYLGLKSIKGVSNDLALWIIEHRPYSNIEDFIAKLPENYLKLPLLEPLVKVGLFDSFEKNRQKVFNNLANLFEFVKELGSLFGDAIYSWQESEDWTEQEKFYMEQELLGIGVSKHPLQAIASKAIYPITPIGNLSENSYAIILVEVQKIKVIRTKKGENMAFLQADDSKKKLDVTLFSDLYRQVGQEIKEGAFYYVKGKIQSRDGRLQMIAQEIREAVAERFWIQVKNHESDQEISRILEQFKGPIPVIIRYEEEQKTIVSPHHFVAKSNELEEKLNEIVMKTIYR

SEQ ID NO: 5098 - protein, 62 aa, Streptococcus pneumoniae
MAAFIPGASPPLVKTAIRFILVYAPFSFNILLDYITFDFKILLFSVFLAINRFHNDFIQFLL

SEQ ID NO: 5099 - protein, 335 aa, Streptococcus pneumoniae
MKRIAVLTSGGDAPGMNAAIRAVVRQAISEGMEVFGIYDGYAGMVAGEIHPLDAASVGDIISRGGTFLHSARYPEFAQLEGQLKGIEQLKKHGIEGVVVIGGDGSYHGAMRLTEHGFPAIGLPGTIDNDIVGTDFTIGFDTAVTTAMDAINKIRDTSSSHRRTFVIEVMGRNAGDIALWAGIATGADEIIIPEAGFKMEDIVASIKAGYECGKKHNIIVLAEGVMSAAEFGQKLKEAGDTSDLRVTELGHIQRGGSPTARDRVLASRMGAHAVKLLKEGIGGVAVGIRNEKMVENPILGTAEEGALFSLTAEGKIVVNNPHKADIELSSLNKSLS

SEQ ID NO: 5100 - protein, 235 aa, Streptococcus pneumoniae
MNKRVKIVATLGPAVEIRGGKKFGEDGYWGEKLDVEASAKNIAKLIEAGANTFRFNFSHGDHQEQGERMATVKLAEKIAGKKVGFLLDTKGPEIRTELFEGEAKEYSYKTGEKIRVATKQGIKSTREVIALNVAGALDIYDDVEVGRQVLVDDGKLGLRVVAKDDATREFEVEVENDGIIAKQKGVNIPNTKIPFPALAERDNDDIRFGLEQGINFIAISFVRTAKECERSSCNL

SEQ ID NO: 5101 - protein, 304 aa, Streptococcus pneumoniae
LLNAITTISVSVLNKVSTSSQFHSYVLQKNVNEVRAICEETGNGHVQLFAKIENQQGIDNLDEIIEAADGIMIARGDMGIEVPFEMVPVYQKMIIKKVNAAGKVVITATNMLETMTEKPRATRSEVSDVFNAVIDGTDATMLSGESANGKYPLESVTTMATIDKNAQALLNEYGRLDSDSFERNSKTEVMASAVKDATSSMDIKLVVTLTKTGHTARLISKYRPNADILALTFDELTERGLMLNWGVIPMLTDAPSSTDDMFEIAERKAVEAGLVESGDDIVIVAGVPVGEAVRTNTMRIRTVR

SEQ ID NO: 5102 - protein, 73 aa, Streptococcus pneumoniae
LSIVAIVVTDSSGYLPFADSPDSIVASVPSITALNTSDTSERVARGFSVIVSSMFVAVITTLPAALTFLIIIF

SEQ ID NO: 5103 - protein, 66 aa, Streptococcus pneumoniae
RKAFNITLQKANTKLEKPINQPLSSHIFRHTLLSTLAEKNAIMVRVEHKNAKTVNNIYTHVSKRME

SEQ ID NO: 5104 - protein, 100 aa, Streptococcus pneumoniae
PLDAGQRFRYGVSIIPDDYDPIAYVVSKSMEPKIRNSDYLFIKNTPQIDYNTIGIFQVDGANYVKKLRQGYLKKTQSQIPRHPPRRKQPYSYHRESCQAI

SEQ ID NO: 5105 - protein, 84 aa, Streptococcus pneumoniae
LDTKIGISKNTIRNYEKRVRSTKKNTIFDLVKVFSSLIDALFSPVQKDSPSDIQSIYDQRAPPRQGKVLTYAERQLYDQKNEVS

SEQ ID NO: 5106 - protein, 290 aa, Streptococcus pneumoniae
MKKSRKLATLGICSALFLGLAACQQQHATSEGTNQRQSSSAKVPWKASYTNLNNQVSTEEVKSLLSAHLDPNSVDAFFNLVNDYNTIVGSTGLSGDFTSFTHTEYDVEKISHLWNQKKGDFVGTNCRINSYCLLKNSVTIPKLEKNDQLLFLDNDAIDKGKVFDSQDKEEFDILFSRVPTEATTDVKVHAEKMETFFSQFQFNEKARMLSVVLHDNLDGEYLFVGHVGVLVPADDGFLFVEKLTFEEPYQAIKFASKEDCYKYLGTKYADYTGEGLAKPFIMDNDKWVKL

SEQ ID NO: 5107 - protein, 127 aa, Streptococcus pneumoniae
MNYEASKQLTDARFKCLVGVQRTTFEEILAVLKTAYQLKHTKGGRKPKLSLEDLLMATLQYVREYRTYEQIAAVFGIHESNLLRRSQWVEVTLVQSSFTISRTPLSSEDTVMIDRHSHQYRIFGHSQ

SEQ ID NO: 5108 - protein, 103 aa, Streptococcus pneumoniae
MELKDFTEKEQEMIKKRLTMSNISDKETTEKILALVPQDLIKRIPFFVRKHATTRTIKRISIEHPELYAVAQTSGEIPEKECEELRQIITTIFEQKMNKHSIK

SEQ ID NO: 5109 - protein, 238 aa, Streptococcus pneumoniae
MKKYFIGGLGSNAYHSKDFLQELDSQVYFLNPYEKHLRDETELKSWFKNEIVEEEFICLIGHSLGGDLARYLASEFEEVKKLILLDGGYLDLDKILPLDTELEETKNYIKSQIVLDLDVLTSKEKSEAKHWSENMEKAVRQSYHWNVEYNRYELAINYENIEAILRLRRKIQAFKREVGDTLFISPRYPNEATWREEALKELPDYFDTIFLENFGHELYTQAPKEIASLMNEWLAYFL

SEQ ID NO: 5110 - protein, 131 aa, Streptococcus pneumoniae
LFVFILIFLKSSIYIGIFWFIDFGKAVDFQGWKVLFEFFMVVIDQFSFGCYPSVVFILPGIALGQQSIDTRICDTVDNAESEQKLTIGMTGVVIDKACKLDCLALKLIWIVVDSLHDFHIVFISDLNTILG

SEQ ID NO: 5111 - protein, 271 aa, Streptococcus pneumoniae
MIRFLVLAGYFELTIYLHLSGKLNQYINMHYSYLAYISMVLSFILAIVQLYIWMKQVKTHSHLNSRLAKMTSISLLAIPLVIGLTFPTVSLDSQTVSAKGYHFPLSEGTDLAIQTSEGTTSQYLKPDTSSYFSKSAYEKEMRTAADKYLSQDSIQITNENYMEVMEAIYDYPDEFEGKTIQFTGFVYNDPSHANSQFLFRFGIIHCIADSGVYGLLTKGNTRQYENNTWITAKGKLVNHYHKELKQNLPTLEIDSFTKVDKPENPYVYRAF

SEQ ID NO: 5112 - protein, 301 aa, Streptococcus pneumoniae
MTAFQQLPSSVLQTGAIFLSIIIEALPFVLIGSIVSGLIEVYITPDKVYHFLPRNRWGRIFFGTFVGILFPSCECGIVPIINRFLEKKVPSYTAVPFLVTAPVINPIVLFATYSAFGNSFHVALLRALGSIVVAVILGIFLGFFWQEPIQKENRLACHEHDFSHLSPAKKVFQVFVQAIDEFFDTGRYLVFGCLFASVIQVYVPTRILTSISATPLFAILLLMILAFLLSLCSEADAFIGASLLSSFGLAPVLAFLVIGPMLDIKNILMMKNYLKARFISHFITIVTLVVLAYSLLIGVIL

SEQ ID NO: 5113 - protein, 709 aa, Streptococcus pneumoniae
MDKKYEKISQDLGVTLKQIDTVLSLTAEGATIPFIARYRKDMTGSLDEVAIKAIIDLDKSLTNLNDRKEAVLAKIQEQGKLTKELEEAILVAEKLADVEELYLPYKEKRRTKATIAREAGLFPLARLILQNIVDLEKEAEKFVCEGFATGKEALTGAVDILVEALSEDVTLRSMTYQEVLRHSKLTSQAKDESLDEKQVFQIYYDFSETVGTMQGYRTLALNRGEKLGVLKIGFEHATDRILAFFATRFKVKNAYIDEVVQQSVKKKVLPAIERRIRTELTEKAEEGAIQLFSDNLRNLLLVAPLKGRVVLGFDPAFRTGAKLAVVDATGKMLTTQVIYPVKPASARQIEEAKKDLADLIGQYGVEIIAIGNGTASRESEAFVAEVLKDFPEVSYVIVNESGASVYSASELARQEFPDLTVEKRSAISIARRLQDPLAELVKIDPKSIGVGQYQHDVSQKKLSESLDFVVDTVVNQVGVNVNTASPALLSHVAGLNKTISENIVKYREEEGKITSRSQIKKVPRLGAKAFEQAAGFLRIPESSNILDNTGVHPENYTAVKELFKRLDIKDLNEEAQSKLKSLSVKEMAQELDLGPETLKDIIADLLKPGRDFRDSFDAPVLRQDVLDIKDLVVGQKLEGVVRNVVDFGAFVDIGIHEDGLIHISHMSRKFIKHPSQVVSVGDLVSVWVKQIDTEREKVNLSLLAPNETD

SEQ ID NO: 5114 - protein, 149 aa, Streptococcus pneumoniae
MKLTDYVKQVSLEDFGRPFIHHVQWNRRLRSTGGRFFPKDGHLDFNPKVYQELGLDVFRKIVRHELCHYHLYFQGKGYQHKDRDFKELLKAVDGLRFVPSLPNSNSKPLKLYRCQSCQQTYQRKRRIDTKRYRCGLCRGKLLLINQPED

SEQ ID NO: 5115 - protein, 84 aa, Streptococcus pneumoniae
MSNLAERGNIMNSKFYKMRRNRMISGVLAGLSDKWNFDVTLVRFLFAIFTVANFGLGVIIYIILASIMPTKEEIEAEMYGTGPR

SEQ ID NO: 5116 - protein, 63 aa, Streptococcus pneumoniae
MKHKEHILIGLLYLLSPFIGQLLVEHTHFIGTEFTGTAYVICWLSVVISTHHFSKNVWSQQQK

SEQ ID NO: 5117 - protein, 252 aa, Streptococcus pneumoniae
MTLLDVKHVQKIYKTRFQGNQVEALKDIHFTVEKGDYVAIMGESGSGKSTLLNILAMLDKPSRGQVYLNGTDTATIKNSQASSFRREKLGFVFQDFNLLDTLSVKDNILLPLVLSRRPITEMMKKLVVTAENLGINQLQEKYPYEISGGQKQRVAVARAIITEPEILLADEPTGALDSKSSAALLDVFDEINERGQTILMVTHSTAAASRAKRVLFIKDGILYNQIYRGEKTERQMFQEISDTLTVMASEVN

SEQ ID NO: 5118 - protein, 74 aa, Streptococcus pneumoniae
LIKSTRLALLAAAVEWVTMRMVWPRSLISSKTSSKAADDLESRAPVGSSARRISGSVMMARATATRCFWPPEIS

SEQ ID NO: 5119 - protein, 662 aa, Streptococcus pneumoniae
MFRLTNKLAVSNLIKNRKLYYPFALAVLLAVTLTYLFYSLTFNPKIAEIRGGTTIQATLGFGMFVVTLASAIIVLYANSFVMKNRSKELGIYGMLGLEKRHLISMTFKELVVFGILTVGAGIGIGALFDKLIFAFLLKLMKLKVELVATFQTKVVITVLVVFGLIFLGLMFLNALRIARMNALQLSREKASGEKKGRFLPLQTILGSISLGIGYYLALTVKDPLTALTTFFIAVLLVIFGTYLLFNAGITVFLQILKKNKKYYYQPNNLISVSNLIFRMKKNAVGLATIAILSTMVLVTMSAATSIFNSAESFKKVLNPHDFGVSGQNVEKEDLDKLLSQFASDNGYKIKEKEVFRYTYFGVANQEGNKLTFFEKGQNRVQPTTVFMVFDQKDYENMTGQKLSLSGNEVGLFAKNDGLKGQKTLILNDHQFSVKEEFNKDFIVNHVPNQFNILTADYNYLVVPDLQAFLNQFPDSDIYNQFYGGMNVNVSEEEQLKVAEEYENYLNQFNAQLDTEGSYVYGSNLADASSQMSALFGGVFFIGIFLSIIFMVGTVLVIYYKQISEGYEDRERFIILQKVGLDQKQIKQTIHKQVLTVFFLPLLFAFIHLAFAYHMLSLILKVIGVLDTTMMLIVTLSICAIFLIAYVLIFMITSRSYRKIVQM

SEQ ID NO: 5120 - protein, 196 aa, Streptococcus pneumoniae
VVIGVASATTNIWIIFLSGFAAILAGAFSMAGGEYVSVSTPKDTEEAAVSREKLLLDQDRELAKKSLYAAYIQNGECKTSAQLLTNKIFLKNPLKALVEEKYGIEYEEFTNPWHAAISSFVAFFLRSLPPMLSVTIFPSEYRIPATVLIVGVALLLTGYTSARLGKDPTRTAMIRNLAIGLLTRGVTFLLEQLFSI

SEQ ID NO: 5121 - protein, 364 aa, Streptococcus pneumoniae
VLYLLFNHKHKKGTEMQDNYTTKGKHLTIDSRRLIERWKKEGKSNREIASLLGKAPQTIHTKIKRRTVRKCLGKGRFKEVYSADYAQQSYENNRKRSVKKSSLTKELKEKILHYHNQKFSPEMMVMAKGVNVGISTIYYWIHHGKLGLSKQDLLYPRKGKVLKKQASTNFKPAGQSIAQRPEAINLRLENGHYEIDTVLLTRSKNYCLLVLTDRKSRHQIIRLIPNKSAEVVNQALKLILKQHKILSITADNGTEFNRLSDVFSEEHIYYAHPYASWERGTNENHNRLIHRWLPKGTKKMTPKEVAFIEKWINNYPKKCLNYKSPREDFLMANLNLKFSVRNKSRNRFKFCRSFKYPARRCSWC

SEQ ID NO: 5122 - protein, 60 aa, Streptococcus pneumoniae
VAFQPRFGIQPCLSVGIFYSGLYLLENIISFSKLYYYIMFLRTCKVFFDKKQKYNRLKLE

SEQ ID NO: 5123 - protein, 491 aa, Streptococcus pneumoniae
LKELDQNQAPIYEALVKLRKKRIVPFDVPGHKRGRGNPELVELLGEKCVGIDVNSMKPLDNLGHPISIIRDAEELAADAFGASHAFLMIGGTTSSVQTMILATCKAGDKIILPRNVHKSAINALVLCGAIPIYIEMSVDPKIGIALGLENDRVAQAIKDHPDAKAILINNPTYYGICSDLKGLTEMAHEAGMMVLVDEAHGAHLHFTGKLPISAMDAGADMAAVSMHKSGGSLTQSSLLLIGEQMNPEYVRQIINLTQSTSASYLLMASLDISRRNLALRGKESFEEVIELSEYARHEINAIGGYYAYSKELIDGVSVCDFDVTKLSVYTQGIGLTGIEVYDLLRDEYDIQIEFGDIGNILAYISIGDRIQDIERLVGALADIKRLYSRDGKDLIAGEYIQPELVLSPQEAFYSERKSLTLDESVGQVCGEFVMCYPPGIPILAPGERITREIVDYIQFAKERGCSLQGTEDPEVNHINVIKRKTNYKKSQ

SEQ ID NO: 5124 - protein, 78 aa, Streptococcus pneumoniae
LDKIVGKHSEYTYQLLTRYPNPQKRIEAGFDKLIEIKRLTASNSRAFCRALKSSPNHQIEIRNSLDKTIDFSYSLSFS

SEQ ID NO: 5125 - protein, 175 aa, Streptococcus pneumoniae
MLYVGIDVAKNKHDVTALNVPGKTVLKPLTFSNNKAGFELLDLSLRQLNQDCLIALENTGHYAFNLLNFLHEQGYKVYTYNPLLIKEFAKSLSLRKTKTDKKDAHGIALKLLSDPNREQFQHDNRQVELKILARHIHRLKKNSLIGKYNTLVVLISSFLSWIKSLESIQNIPTNS

SEQ ID NO: 5126 - protein, 286 aa, Streptococcus pneumoniae
MDLWFSEVHTPDVKLSLRTAKQLYAGKSEWQDIEVLDTPAFGKILILNGHVLFSDADDFVYNEMTVHVPMAVHPNPKKVLVIGGGDGGVAQVLTLYPELEQIDIVEPDEMLVEVCREYFPDFAAGLDDPRVTIYYQNGLRFLRNCEDDYDIIINDATDPFGHTEGLFTKEFYGNSYRALKEDGIMIYQHGSPFFDEDESACRSMHRKVNQAFPISRVYQAHIPTSPAGYWLFGFASKKYHPVKDFDKEGWKKRQLFTEYYTANLHVGSFMLPKYVEDILEEEEGKK

SEQ ID NO: 5127 - protein, 419 aa, Streptococcus pneumoniae
MSRLLVIGCGGVAQVAISKICQDSETFTEIMIASRTKSKCDDLKAKLEGKTSTKIETAALDADKVEEVIALIESYKPEAVLNVALPYQDLTIMDACLATGVHYIDTANYEAEDTEDPEWRAIYEKRCKELGFTAYFDYSWQWAYQEKFKEAGLTALLGSGFDPGVTSVFSAYALKHYFDEIHYIDILDCNGGDHGYPFATNFNPEINLREVSAPGSYWEDGKWVEVEAMSIKREYDFPQVGQKDMYLLHHEEIESLAKNIPGVKRIRFFMTFGQSYLTHMKCLENVGLLRTDTINFNGQEIVPIQFLKALLPDPASLGPRTVGKTNIGCIFTGVKDGVEKTIYIYNVCDHQECYAEVGSQAISYTTGVPAMIGTKLVMNGTWKQAGVYNLEELDPDPFMEALNEYGLPWVVVENPQMVD

SEQ ID NO: 5128 - protein, 375 aa, Streptococcus pneumoniae
MKLEQVPTPAYVIDLAKLEANCRILQYVQEEVGCKVLLAQKAYSLYKTYPLISQYLSGTTASGLYEAKLAREEFPGEVHVFAPAFKDADLEELLEIMDHIVFNSERQLRKHGPRCREAGVSVGLRLNPQCSTQGDHALYDPCAPGSRFGVTIDKIPSDLLDLVDGLHFHTLCEQGADDLQTTLKAVEEQFGPYLHEVKWLNMGGGHHITREGYDVDLLISEIKRIRKTYNLEIYIEPGEAIALNAGYLATEVLDIVENGMEILVLDASATCHMPDVLEMPYRPSLRNGFEAQEKAHTYRLSSNTCLTGDVIGDYSFENPVQIGDRLYFQDMAIYSFVKNNTFNGIGLPSLYLMDEQGDCSLLKAFGYQDFKGRLS

SEQ ID NO: 5129 - protein, 361 aa, Streptococcus pneumoniae
MMDSPKKLGYHMPAEYEPHHGTLMIWPTRPGSWPFQGKAAKRAFTQIIETIAEGERVYLLVEQAYLSEAQSYLGDKVVYLDIPTNDAWARDTGPTILVNDKGKKLAVDWAFNAWGGTYDGLYQDYEEDDQVASRFAEALGRPVYDAKPFVLEGGAIHSDGQGTILVTESCLLSPGRNPNLTKEEIENTLLESLGAEKVIWLPYGIYQDETNEHVDNVAAFVGPAELVLAWTDDENDPQYAMSKADLELLEQETDAKGCHFTIHKLPIPAVRQVVTEEDLPGYIYEEGEEKRYAGERLAASYVNFYIANKAVLVPQFEDVNDQVALDILSKCFPDRKVVGIPARDILLGGGNIHCITQQIPE

SEQ ID NO: 5130 - protein, 291 aa, Streptococcus pneumoniae
MRNVRVATIQMQCAKDVATNIQTAERLVRQAAEQGAQIILLPELFEHPYFCQERQYDYYQYAQSVAENTAIQHFKVIAKELQVVLPISFYEKDGNVLYNSIAVIDADGEVLGVYRKTHIPDDHYYQEKFYFTPGNTGFKVWNTRYAKIGIGICWDQWFPETARCLALNGAELLFYPTAIGSEPILDTDSCGHWQRTMQGHAAANIVPVIAANRYGLEEVTPSEENGGQSSSLDFYGSSFMTDETGAILERAERQEEAVLLATYDLDKGASERLNWGLFRDRRPEMYRQITD

SEQ ID NO: 5131 - protein, 269 aa, Streptococcus pneumoniae
MIKLLALDMDGTLLNEAKEIPQAHIAAIHQAIEKGVKLVLCTGRPLFGVLPYYKKLGLDLQNEYVIVNNGCSTHQTSDWGLVDWQELSPADIEYLYDLAEKSDVQLTLFDESHYFVLGGKPNQVIENDAKLVFSDLTEISLEEATSGKLRMFQGMFLGTKEQTDDFEQRFAEELCQRFSGVRSQPVIYEAMPLGTTKATALSRLAEILKIDSSEIMAMGDANNDIEMLQFAGLGIAMGNASDYVKSLADAVTSSNEEDGVARAIEKYIL

SEQ ID NO: 5132 - protein, 73 aa, Streptococcus pneumoniae
MILMTKNINLTNEELELIQGGADPYGKNPNGRYDWEIEPVLTLPVHGFCPRGTYDLGYIGGGNHLCKGSAARF

SEQ ID NO: 5133 - protein, 223 aa, Streptococcus pneumoniae
MKKRAIQILLALSLIFYKSTWFWRVFNHLAKPYLPASREFFQILLLMESGVLFLAVIYLLVFAGKKIFHFKWQLRYFIYLLLGYIISYMSDFLFSYFISLSSNQISLNETVEMMGRQEFPYFLLIVCFIAPIAEELIYRGVLMTTFFKNSPWYGDVLLSAIIFGYIHINFALTPLAFFIYASGGLILALLYRMTKNLYYPILVHILINITAFWDVWLLLFSGS

SEQ ID NO: 5134 - protein, 302 aa, Streptococcus pneumoniae
MNIQQLRYVVAIANSGTFREAAEKMYVSQPSLSISVRDLEKELGFKIFRRTSSGTFLTRRGMEFYEKSQELVKGFDIFQNQYANPEEEKDEFSVASQHYDFLPPTITAFSERYPDYKNFRIFESTTVQILDEVAQGHSEIGIIYLNNQNKKGIMQRVEKLGLEVIELIPFHTHIYLREGHPLAQKEELVMEDLADLPTVRFTQEKDEYLYYSENFVDTSASSQMFNVTDRATLNGILERTDAYATGSGFLDSDSVNGITVIRLKDNLDNRMVYVKREEVELSQAGTLFVEVMQEYFDQKRKS

SEQ ID NO: 5135 - protein, 153 aa, Streptococcus pneumoniae
MKKRAIVAVIVLLLIGLDQLVKSYIVQQIPLGEVRSWIPNFVSLTYLQNRGAAFSILQDQQLLFAVITLVVVIGAIWYLHKHMEDSFWMVLGLTLIIAGGLGNFIDRASQGFVVDMFHLDFINFAIFNVADSYLTVGVIILLIAMLKEEINGN

SEQ ID NO: 5136 - protein, 295 aa, Streptococcus pneumoniae
MEIKIETGGLRLDKALSDLSELSRSLANEQIKSGQVLVNGQVKKAKYTVQEGDVVTYHVPEPEVLEYVAEDLPLEIVYQDEDVAVVNKPQGMVVHPSAGHTSGTLVNALMYHIKDLSGINGVLRPGIVHRIDKDTSGLLMIAKNDDAHLALAQELKDKKSLRKYWAIVHGNLPNDRGVIEAPIGRSEKDRKKQAVTAKGKPAVTRFHVLERFGDYSLVELQLETGRTHQIRVHMAYIGHSVAGDEVYGPRKTLKGHGQFLHAKTLGFTHPRTGKTLEFKADIPEIFKETLERLRK

SEQ ID NO: 5137 - protein, 627 aa, Streptococcus pneumoniae
MKKKLTSLALVGAFLGLSWYGNVQAQESSGNKIHFINVQEGGSDAIILESNGHFAMVDTGEDYDFPDGSDSRYPWREGIETSYKHVLTDRVFRRLKELGVQKLDFILVTHTHSDHIGNVDELLSTYPVDRVYLKKYSDSRITNSERLWDNLYGYDKVLQTAAEKGVSVIQNITQGDAHFQFGDMDIQLYNYENETDSSGELKKIWDDNSNSLISVVKVNGKKIYLGGDLDNVHGAEDKYGPLIGKVDLMKFNHHHDTNKSNTKDFIKNLSPSLIVQTSDSLPWKNGVDSEYVNWLKERGIERINAASKDYDATVFDIRQDGLVNISTSYKPIPSFQAGWHKSAYGNWWYQAPDSTGEYAVGWNEIEGEWYYFNQTGILLQNQWKKWNNHWFYLTDSGASAKNWKKIDGIWYYFNKENQMEIGWVQDKEQWYYLDVDGSMKTGWLQYMGQLYYFAPSGEMKTGWVKDKEAWYYMDSTGIMKTGEIEVAGHHYYLEESGAMKQGWLKKANDWYFYKTGGSRAIGWIKDKDKWYFLKENGQLLVNGKTPEGYTVDSSGAWLVDVPIEKSATIKTTSHSEIKESKEVVKKDLENKETSQHESVTNSSTSQDLTSSTSQSSETSVNKSESEQ

SEQ ID NO: 5138 - protein, 376 aa, Streptococcus pneumoniae
MNNRSETMKYKRIVFKVGTSSLTNEDGSLSRSKVKDITQQLAMLHEAGHELILVSSGAIAAGFGALGFKKRPTKIADKQASAAVGQGLLLEEYTTNLLLRQIVSAQILLTQDDFVDKRRYKNAHQALSVLLNRGAIPIINENDSVVIDEVKVGDNDTLSAQVAAMVQADLLVLLTDVDGLYTGNPNSDPRAKRLERIETINREIIDMAGGAGSSNGTGGMLTKIKAATIATESGVPVYICSSLKSDSMIEAAEETEDGSYFVAQEKGLRTQKQWLAFYAQSQGSIWVDKGAAEALSQHGKSLLLSGIVEAEGAFSYGDIVTVFDKESGKSLGKGRVQFGASALEDMLRSQKAKGVLIYRDDWISITPEIQLLFTEF

SEQ ID NO: 5139 - protein, 420 aa, Streptococcus pneumoniae
MVSRQEQFEQVQAVKKSINTASEEVKNQALLAMADHLVAATEEILAANALDMAAAKGKISDVMLDRLYLDADRIEAMARGIREVVAFPDPIGEVLETSQLENGLVITKKRVAMGVIGIIYESRPNVTSDAAALTLKSGNAVVLRSGKDAYQTTHAIVTALKKGLETTTIHPNVIQLVEDTSHESSYAMMKAKGYLDLLIPRGGAGLINAVVENAIVPVIETGTGIVHVYVDKDADEDKALSIINNAKTSRPSVCNAMEVLLVHEDKAASILPRLDQMLVAERKEAGLEPIQFRLDSKASQFVSGQAAETQDFDTEFLDYVLAVKVVSSLEEAVAHIESHSTHHSDAIVTENAEAAAYFTDQVDSAAVYVNASTRFTDGGQFGLGCEMGISTQKLHARGPMGLKELTSYKYVVAGDGQIRE

SEQ ID NO: 5140 - protein, 265 aa, Streptococcus pneumoniae
MKIGFIGLGNMGASLAKSVLQTRTSDEILLANRSQAKVDAFIADFGGQASSNEEMFAEADVIFLGVKPAQFSELLSQYQTILEKRESLLLISMAAGLTLEKLASLIPSQHRIIRMMPNTPASIGQGVISYALSPNCRAEDSEIFCQLLAKAGLLVELGESLINAATGLAGCGPAFVYLFIEALADAGVQTGLPRETALKMAAQTVVGAGQLVLESQQHPGVLKDQVCSPGGSTIAGVASLEAHAFRGTVMEAVHQAYKRTQELGK

SEQ ID NO: 5141 - protein, 212 aa, Streptococcus pneumoniae [sequence omitted]

SEQ ID NO: 5142 - protein, 83 aa, Streptococcus pneumoniae
LLQRETSINLDNAISLFIQKRKVALTNFFMQVQPFQIQTINLAVTISSNTSQPFFHLDVKIECQIGFEAICRKLIEPVNGFNI

SEQ ID NO: 5143 - protein, 296 aa, Streptococcus pneumoniae
MKQDQLKAWQPAQFDRFVRILEQDQLNHAYLFSGFFGSLEMAQFLAKSLFCTDKVGVLPCEKCRSCKLIEQEEFPDVTLIKPVNQVIKTERIRELVGQFSQAGIESQQQVFIIEQADKMHPNAANSLLKVIEEPQSEVYIFFLTSDEEKMLPTIRSRTQIFHFKKQEEKLILLLEQMGLVKKKATLLAKFSQSRAEAEKLANQASFWTLVDESERLLTWLVAKKKESYLQVAKLANLADDKEKQDQVLRILEVLCGQDLLQVRVRVILQDLLEARKMWQANVSFQNAMEYLVLKEI

SEQ ID NO: 5144 - protein, 105 aa, Streptococcus pneumoniae
MDKKELFDALDDFSQQLLVTLADVEAIKKNLKSLVEENTALRLENSKLRERLGEVEADAPVKAKHVRESVRRIYRDGFHVCNDFYGQRREQDEECMFCDELLYRE

SEQ ID NO: 5145 - protein, 289 aa, Streptococcus pneumoniae
MQIQKSFKGQSPYGKLYLVATPIGNLDDMTFRAIQTLKEVDWIAAEDTRNTGLLLKHFDISTKQISFHEHNAKEKIPDLIGFLKAGQSIAQVSDAGLPSISDPGHDLVKAAIEEEIAVVTVPGASAGISALIASGLAPQPHIFYGFLPRKSGQQKQFFDSKKDYPETQIFYESPHRVADTLENMLEVYGDRSVVLVRELTKIYEEYQRGTISELLESIAETSLKGECLLIVEGASQDVEEKDEEDLFLEIQARIQQGMKKNQAIKEVAKIYQWNKSQLYAAYHDWEEKQ

SEQ ID NO: 5146 - protein, 181 aa, Streptococcus pneumoniae
LINQKEGDFLRTYENKEELKAEIEKTFEKYILEFDNIPENLKDKRADEVDRTPAENLAYQVGWTNLVLKWEEDERKGLQVKTPSDKFKWNQLGELYQWFTDTYAHLSLQELKAKLNENIHSISAMIDSLSEEELFEPHMRKWADEATKTATWEVYKFIHVNTVAPFGTFRTKIRKWKKIVL

SEQ ID NO: 5147 - protein, 167 aa, Streptococcus pneumoniae
MSFKNNWIDKEGRVFIYFTVEEIMKRRNISKPTAIKTLDELDIKKGIGLIERVRLGLGKPNIIYVKDFMSIFQVKENDLQKSKNLTSEVKDFNLRSKENELQEVKNLDSNYIENNKSKYSKREYSFGENGLGTFQNVFLAAEDISDLQIIMNSQLENYIRLPAKLES

SEQ ID NO: 5148 - protein, 149 aa, Streptococcus pneumoniae
KSIALKKELANYSGKKKCYAMKAQAIVTSQGRIVSLDITVNYCHDMKLFKMSRRNIGQAGKILADSGYQGLMKIYPQAQTPRKSSKFKPLTVEDKTYNHALSKERSKVENIFAKVETFKMFSTTYRNHRKRFGLRMNLIAGIINHELGF

SEQ ID NO: 5149 - protein, 133 aa, Streptococcus pneumoniae
MNDEASKQLTDARFKRLVGVQRTTFEEILAVLKTAYQLKHAKGGRKPKLSLEDLLMATLQYVREYRTYEQIAADFGIHESNLIRRSQWVEVTLVQSGVTISRTPLSSEDTVMIIDATEVKINRPKKRISELFW

SEQ ID NO: 5150 - protein, 90 aa, Streptococcus pneumoniae
LFTCFIIHRTTIPYFVSQEVYWKVRNIEAEAIRRNCERGAIFSGKIKHHEDSQFKGDHYVECYAVLDNTVIARDRITVPIDPLCGKDFIE

SEQ ID NO: 5151 - protein, 444 aa, Streptococcus pneumoniae
VSQSYINVIGAGLAGSEAAYQIAERGIPVKLYEMRGVKSTPQHKTDNFAELVCSNSLRGDALTNAVGLLKEEMRRLGSVILESAEATRVPAGGALAVDRDGFSQMVTEKVVNHPLIEVVRDEITELPTDVITVVATGPLTSDALAEKIHALNNGDGFYFYDAAAPIIDVNTIDMSKVYLKSRYDKGEAAYLNAPMTKQEFMDFHEALVNAEEAPLNSFEKEKYFEGCMPIEVMAKRGIKTMLYGPMKPVGLEYPDDYTGPRDGEFKTPYAVVQLRQDNAAGSLYNIVGFQTHLKWGEQKRVFQMIPGLENAEFVRYGVMHRNSYMDSPNLLEQTYRSKKQPNLFFAGQMTGVEGYVESAASGLVAGINAARLFKEESEVIFPETTAIGSLAHYITHADSKHFQPMNVNFGIIKELEGERIRDTKARYEKIAERALADLEEFLTV

SEQ ID NO: 5152 - protein, 245 aa, Streptococcus pneumoniae
MANPKYKRILIKLSGEALAGERGVGIDIQTVQTIAKEIQEVHSLGIEIALVIGGGNLWRGEPAAEAGMDRVQADYTGMLGTVMNALVMADSLQQVGVDTRVQTAIAMQQVAEPYVRGRALRHLEKGRIVIFGAGIGSPYFSTDTTAALRAAEIEADAILMAKNGVDGVYNADPKKDKTAVKFEELTHRDVINKGLRIMDSTASTLSMDNDIDLVVFNMNQSGNIKRVVFGENIGTTVSNNIEEKE

SEQ ID NO: 5153 - protein, 145 aa, Streptococcus pneumoniae
LVRLGHSLFSFFNNYVSHILSYSFSSILFETVVPIFSPNTTRLMLPDWFMLKTTKSMSLSIERVEAVESMIRRPLLITSRWVNSSNLTAVLSFLGSALYTPSTPFLAMRMASASISAARRAAVVSVEKYGEPIPAPKITIRPFSR

SEQ ID NO: 5154 - protein, 185 aa, Streptococcus pneumoniae
MANVIIEKAKERMTQSHQSLAREFGGIRAGRANASLLDRVHVEYYGVETPLNQIASITIPEARVLLVTPFDKSSLKDIERALNASDLGITPANDGSVIRLVIPALTEETRRDLAKEVKKVGENAKVAVRNIRRDAMDEAKKQEKAQEITEDELKTLEKDIQKVTDDAVKHIDDMTANKEKELLEV

SEQ ID NO: 5155 - protein, 138 aa, Streptococcus pneumoniae
LQDLYSYFLLSNKTQPAMPTEFFCLFLDFQKFFLFVSSHVVDVFNSIVCYFLNIFFKSLQFVFSDFLCFFLFLSFVHSIATDIADSHFSIFADLLHFFSKVTTSFFCKSWDNQANHRTVISRCDTKIRSVQGTFDVFQ

SEQ ID NO: 5156 - protein, 284 aa, Streptococcus pneumoniae
MNTNLASFIVGLIIDENDRFYFVQKDGQTYALAKEEGQHTVGDTVKGFAYTDMKQKLRLTTLEVTATQDQFGWGRVTEVRKDLGVFVDTGLPDKEIVVSLDILPELKELWPKKGDQLYIRLEVDKKDRIWGLLAYQEDFQRLARPAYNNMQNQNWPAIVYRLKLSGTFVYLPENNMLGFIHPSERYAEPRLGQVLDARVIGFREVDRTLNLSLKPRSFEMLENDAQMILTYLESNGGFMTLNDKSSPDDIKATFGISKGQFKKALGGLMKAGKIKQDQFGTELI

SEQ ID NO: 5157 - protein, 71 aa, Streptococcus pneumoniae
MRKSFYTWLMTERNPKSNSPKAILADLAFEESAFPKHTDDFDEVSRFLEEHASFSFNLGDFDSIWQEYLEH

SEQ ID NO: 5158 - protein, 322 aa, Streptococcus pneumoniae
LKEHSIDIQLSHPDDLFHLFGSNERHLRLMEEELDVVIHARTEIVQVLGEESACEEARQVIQALMALVNRGMTVGTPDVVTAISMVKNDEIDKFVALYEEEIIKDNTGKPIRVKTLGQKLYVDSVKQHDVTFGIGPAGTGKTFLAVTLAVTALKRGQVKRIILTRPAVEAGESLGFLPGDLKEKVDPYLRPVYDALYQILGKDQTTRLMEREIIEIAPLAYMRGRTLDDAFVILDEAQNTTIMQMKMFLTRLGFHSKMIVNGDISQIDLPRNVKSGLIDAQEKLKNIHQIDFVHFSAKDVVRHPVVAQIIRAYEYSTEVAHD

SEQ ID NO: 5159 - protein, 64 aa, Streptococcus pneumoniae
LFPVIMTQEDALIVISHIKVLSIVPNRCLKPLDKTFSLYNWIFLSQKYILLQANFLKISRVQLQ

SEQ ID NO: 5160 - protein, 166 aa, Streptococcus pneumoniae
MIDQLSKYYSCRILTEKDIPSILSLYESNPLYFQHCPPEPNFATVKEDMLCLPEGKAKADKFFVGFWNGSDLVAVMDFVYAYPDEETVFIGLFMVDQAYQRKGIGSHIVTEALAYFAKNFRKARLAYVKGNPQSQHFWEKQGFKSIGCEVKQELYTVVIVEQSLED

SEQ ID NO: 5161 - protein, 91 aa, Streptococcus pneumoniae
VTTHDEPVYEKHGVLHYTVANIPGAVARTSTIALTNVTLPYIEALAGKGFAQAISEDEGLRQGVTTYQGYLTSLPVAQGLNRDYTDINDLV

SEQ ID NO: 5162 - protein, 64 aa, Streptococcus pneumoniae
TLISNSFNIEASVRDADVVIGAILIPGAKAPELVTDEMVKQMRPGSVSLTLLLTKVALSKQLTV

SEQ ID NO: 5163 - protein, 72 aa, Streptococcus pneumoniae
IGAHFLTKQAGGSGVLPGGVPGVPKGKVTIIGDGVVGTHAARIALGLGAQVTILDISAKRLSVLKEVFGSQI

SEQ ID NO: 5164 - protein, 141 aa, Streptococcus pneumoniae
MLIGIPKEIKNNENRVALTPAGVHSLVSRGHRVLIETNAGLGSGFTDADYQKQGAEIVATAGEAWAAELVVKVKEPLSSEYGYFRDDLLLFTYLHMAAAPELADAMLAAKTTGIAYETVRDNQGQLPLLVPMSEVADRMAV

SEQ ID NO: 5165 - protein, 195 aa, Streptococcus pneumoniae
LIGWKSMESIFVKLAQYPSIETERLLLRPVTLDDAEAMFDYASDKGNTRYTFPTNQSLEETKNNIAQFYLANPLGRWGIELKSNGQFIGTIDLHKIDSVLKKAAIGYIINKKYWNQGLTTEANRAVIELAFEKIGMNKLTALHDKDNPASGKVMEKSGMRFSHAEPYACMDQHEKGRIVTRVHYVLTKEDYFANK

SEQ ID NO: 5166 - protein, 216 aa, Streptococcus pneumoniae
MEAIIEKIKEYKIIVICTGLGLLVGGFFLLKPAPQTPVKETNLQAEVAAVSKDLVSEKEVNKEEKEEPLEQDLITVDVKGAVKSPGIYDLPVGSRVNDAVQKAGGLTEQADSKSLNLAQKVSDEALVYVPTKGEEAVSQQTGLGTASSISKEKKVNLNKASLEELKQVKGLGGKRAQDIIDHREANGKFKSVDELKKVSGIGGKTIEKLKDYVTVD

SEQ ID NO: 5167 - protein, 458 aa, Streptococcus pneumoniae
MLQWIKNFSIPLIYLSFLLLWLYYAIFSASYLALLGFVFLLVCLFFQFPWKSASKVLVICGIFGFWFVFQNWQQSQASQNLADSVERVRILPDTIKVNGDSLSFRGKSNGRAFQVYYKLQSEEEKEAFQALTDLHEIGLEGKLSEPEGQRNFGGFNYQAYLKTQGIYQTLNIKRIQSLQKVGSWDIGEKLSSLRRKAVVWIKMHFPDPMRNYMTGLLLGHLDTDFEEMNELYSSLGIIHLFALSGMQVGFFMNGFKKLVLRLGLTQEKLKWLTYPFSLIYAGLTGFSASVIRSLLQKLLAQHGVKGLDNFALTVLVLFIVMPNFFLTAGGVLSCAYAFILTMTIKEGKGLKAVASESLVISLGILPIISFYFAEFQPWSILLTFVFSFLFDLTLLPLLSILFVLSFLYPVIQLNFIFEWLEGIIRLVSQVTSRPLVFGQPNEWLLTLLLNILWLWSMI

SEQ ID NO: 5168 - protein, 305 aa, Streptococcus pneumoniae
MAFNPIVKYSLALVYDLRKNLKGLTVLSLLITGLFFLTKYPLENEITMLDVGQGESIFLRDVTGKTILIDVGGKAESYKKIEKWQEKMTTSNAQRTLIPYLKSRGVAKIDQLILTNTDKEHVGDLSEVTKAFHVGEILVSKGSLKQKQFVVELQATKTKVRSMTVGENLPIFGSQLEVLSPRKMGDGGHDDTLVLYGKFLDKQFLFTGNLEEKGEKDLLKHYPDLKVNVLKASQHGNKKSSSPAFLEKLKPELTLISVGKSNRMKLPHQETLTRLEGINSKVYRTDQQGAIRFKGLDSWKIESVR

SEQ ID NO: 5169 - protein, 195 aa, Streptococcus pneumoniae
MLQLTHVTLKTRQVILQDADFTFKKGRFYGLLAINGSGKTTLFRAISNLIPISSGNIAAPPSLFYYESIEWLDGNLSGMDYLRLIKNIWKSDLNLRDEIAYWEMADYISLPIRKYSLGMKQRLVIAMYFLSQAKCWLMDEITNGLDEYYRQKFFDRLAQIDRQEQLVLLSSHYKEELVDICDRVVTIHQGQIEEV

SEQ ID NO: 5170 - protein, 391 aa, Streptococcus pneumoniae
MKDVSLFLLKKVFKSRLNWIILLLFASVLGVTFYLNSQTANSHSLESRLESRIAANERAINENEAKLSQMSDTSSEEYQFAKSNLELQKNLLKRKTEILTLLKEGRWKEAYYLQWQDEEKNYEFVSNDPTASSGLKMGVDRERKIYQALYPLNIKAHTLEFPTHGIDQIIWILEAIIPSLFVVAIIFMLTQLFAERYQNHLDTAHLYPVSKVTFAMSSLGVGVGYVTVLFIGICGFSFLVGSLISGFGQLDYPYPIYSLVKQEVTIGKMQDVLFPSLLLAFLAFIVIVEVVYLIAYFFKQKMPVLFLSLIGIVGLLFGIQTIQPLQKIAHLIPFTYLRSVEILSGRLPKQIDNVDLNWSMGMVLLPCLIIFLLLGILFIERWGSSQKKRIF

SEQ ID NO: 5171 - protein, 87 aa, Streptococcus pneumoniae
IYKPARYDSVSSKLFIRRARQLNVTRREALTSAFLNFYMIPSFLALVKIKSYFLKSLCLYFGLVFKSKRENQVDSLSMLVFTYFPYL

SEQ ID NO: 5172 - protein, 195 aa, Streptococcus pneumoniae
VRACIFTSPLLFFSNKTKEVKTIAKQDLFINDEIRVREVRLIGLEGEQLGIKPLSEAQALADNANVDLVLIQPQAKPPVAKIMDYGKFKFEYQKKQKEQRKKQSVVTVKEVRLSPTIDKGDFDTKLRNARKFLEKGNKVKVSIRFKGRMITHKEIGAKVLAEFAEATQDIAIIEQRAKMDGRQMFMQLAPATDKK

SEQ ID NO: 5173 - protein, 66 aa, Streptococcus pneumoniae
MPKQKTHRASAKRFKRTGSGGLKRFRAYTSHRFHGKTKKQRRHLRKASMVHSGDYKRIKAMLTRLK

SEQ ID NO: 5174 - protein, 119 aa, Streptococcus pneumoniae
MARVKGGVVSRKRRKRILKLAKGYYGAKHILFRTAKEQVMNSYYYAYRDRRQKKRDFRKLWITRINAAARMNGLSYSQLMHGLKLAEIEVNRKMLADLAVNDAVAFTALADAAKAKLGK

SEQ ID NO: 5175 - protein, 126 aa, Streptococcus pneumoniae
MASKMLHTCLRVENLEKSIAFYQDAFGFKELRRRDFPDHAFTIVYLGLEGDDYELELTYNYDHGPYVVGDGFAHIALSTPDLEALHQEHSAKGYEVTEPNGLPGTTPNYYFVKDPDGYKVEVIREK

SEQ ID NO: 5176 - protein, 189 aa, Streptococcus pneumoniae
MNLTCKKRLGVIRLETMKVVAQEEIAPAIFELVLEGEMVEAMRAGQFLHLRVPDDAHLLRRPISISSIDKANKQCHLIYRIEGAGTAIFSTLSQGDTLDVMGPQGNGFDLSDLDEQNQVLLVGGGIGVPPLLEVAKELHERGVKVVTVLGFANKDAVILKTELAQYGHVFVTTDDGSYGIKGNVSRCFS

SEQ ID NO: 5177 - protein, 93 aa, Streptococcus pneumoniae
MMVLMASREMFPVVFHDLNSQFEPLYSCGAPLMMKYINQTFDDHPRAYLSLESRMACGMGACYACVLKVPENETVSQRVCEDGPVFRTGTVVL

SEQ ID NO: 5178 - protein, 312 aa, Streptococcus pneumoniae
MTTNRLQVSLPGLDLKNPIIPASGCFGFGQKYAKYYDLDLLGSIMIKATTLEPRFGNPTPRVAETPAGMLNAIGLQNPGLEVVLAEKLPWLEREYPNLPIIANVAGFSKQEYAAVSHGISKATNVKAIELNISCPNVDHCNHGLLIGQDPDLAYDVVKAAVEASEVPVYVKLTPSVTDIVTVAKAAEDAGASGLTMINTLVGMRFDLKTRKPILANGTGGMSGPAVFPVALKLIRQVAQTTDLPIIGMGGVDSTEAALEMYLAGASAIGVGTANFTNPYACPDIIENLPKVMDKYGISSLEELRQEVKESLR

SEQ ID NO: 5179 - protein, 721 aa, Streptococcus pneumoniae
MNLGEFWYNKINKTIGRRLMKKVRFIFLALLFFLASPEGAMASDGTWQGKQYLKEDGSQAANEWVFDTHYQSWFYIKADANYAENEWLKQGDDYFYLKSGGYMAKSEWVEDKGAFYYLDQDGKMKRNAWVGTSYVGATGAKVIEDWVYDSQYDAWFYIKADGQHAEKEWLQIKGKDYYFKSGGYLLTSQWINQAYVNASGAKVQQGWLFDKQYQSWFYIKENGNYADKEWIFENGHYYYLKSGGYMAANEWIWDKESWFYLKFDGKIAEKEWVYDSHSQAWYYFKSGGYMAANEWIWDKESWFYLKFDGKMAEKEWVYDSHSQAWYYFKSGGYMTANEWIWDKESWFYLKSDGKIAEKEWVYDSHSQAWYYFKSGGYMTANEWIWDKESWFYLKSDGKMAEKEWVYDSHSQAWYYFKSGGYMAKNETVDGYQLGSDGKWLGGKATNENAAYYQVVPVTANVYDSDGEKLSYISQGSVVWLDKDRKSDDKRLAITISGLSGYMKTEDLQALDASKDFIPYYESDGHRFYHYVAQNASIPVASHLSDMAVGKKYYSADGLHFDGFKLENPFLFKDLTEATNYSAEELDKVFSLLNINNSLLENKGATFKEAEEHYHINALYLLAHSALESNWGRSKIAKDKNNFFGITAYDTTPYLSAKTFDDVDKGILGATKWIKENYIDRGRTFLGNKASGMNVEYASDPYWGEKIASVMMKINEKLGGKD

SEQ ID NO: 5180 - protein, 560 aa, Streptococcus pneumoniae
MEYNHKERTMSFDGFFLHHIVEELRSELVNGRIQKINQPFEQELVLQIRSNRQSHRLLLSAHPVFGRIQLTQTTFENPAQPSTFIMVLRKYLQGALIESIEQVENDRIVEITVSNKNEIGDHIQATLIIEIMGKHSNILLVDKSSHKILEVIKHVGFSQNSYRTLLPGSTYIAPPSTESLNPFTIKDEKLFEILQTQELTAKNLQSLFQGLGRDTANELERILVSEKLSAFRNFFNQETKPCLTETSFSPVPFANQVGEPFANLSDLLDTYYKDKAERDRVKQQASELIRRVENELQKNRHKLKKQEKELLATDNAEEFRQKGELLTTFLHQVPNDQDQVILDNYYTNQPIMIALDKALTPNQNAQRYFKRYQKLKEAVKYLTDLIEETKATILYLESVETVLNQAGLEEIAEIREELIQTGFIRRRQREKIQKRKKLEQYLASDGKTIIYVGRNNLQNEELTFKMARKEELWFHAKDIPGSHVVISGNLDPSDAVKTDAAELAAYFSQGRLSNLVQVDMIEVKKLNKPTGGKPGFVTYTGQKTLRVTPDSKKIASMKKS

SEQ ID NO: 5181 - protein, 76 aa, Streptococcus pneumoniae
LLLSTSRILLCFPIISIIKVAWIWSPISFLLETVISTIRSFSTCSIDSIRAPCKYFLKTMIKVEGWAGFSKVVWVS

SEQ ID NO: 5182 - protein, 165 aa, Streptococcus pneumoniae
MYIEMVDETGQVSKEMLQQTQEILEFAAKKLGKEDKEMAVTFVTNERSHELNLEYRDTDRPTDVISLEYKPELEIAFDEEDLLENPELAEMMSEFDAYIGELFISIDKAHEQAEEYGHSFEREMGFLAVHGFLHINGYDHYTPEEEAEMFGLQEEILTAYGLTRQ

SEQ ID NO: 5183 - protein, 131 aa, Streptococcus pneumoniae
MDSQDNKRKWKNRDLISSLEFAITGIFTAIKEERNMRKHAVTALVVILAGFGFQVSRIEWLFLLLSIFLVVAFEIINSAIENVVDLASHYHFSMLAKNAKDMAAGAVFVVSLFAALTGALIFLPRIWDLLF

SEQ ID NO: 5184 - protein, 299 aa, Streptococcus pneumoniae
MTFKSGFVAILGRPHVGKSTFLNHVMGAKIAIMSDKAQTTRNKIMGIYTTDKEQIVFIDTPGIHKPKTTLGDFMVESAYSTLREVDTVLFMVPADEARGKGDDMIIERLKAAKVPVILVVNKIDKVHPDQLLSQIDDFRNQMDFKEIVPISALQGNNVSRLVDILSENLDEGFQYFPSDQITDHPERFLVSEMVREKVLHLTREEIPHSVAVVVDSMKRDEETDKVHIRATIMVERDSQKGIIIGKGGAMLKKIGSMARRDIELMLGDKVFLETWVKVKKNWRDKKLDLADFGYNEKEY

SEQ ID NO: 5185 - protein, 274 aa, Streptococcus pneumoniae
MPELPEVETVCRGLEKLIIGKKISSIEIRYPKMIKTDLEEFQRELPSQIIESMGRRGKYLLFYLTDKVLISHLRMEGKYFYYPDQGPERKHAHVFFHFEDGGTLVYEDVRKFGTMELLVPDLLDAYFISKKLGPEPSEQDFDLQVFQSALAKSKKPIKSHLLNQTLVAGLGNIYVDEVLWRAQVHPARPSQTLTAEEATAIHDQTIAVLGQAVEKGGSTIRTYTNAFGEDGSMQDFHQVYDKTGQECVRCGTIIEKIQLGGRGTHFCPNCQRKD

SEQ ID NO: 5186 - protein, 60 aa, Streptococcus pneumoniae
LVDEWVGNPMVESPCCFRKFVTVDLPEAIPPVIPMIFPISPSFDSLDKSGFHVRLVEFSQ

SEQ ID NO: 5187 - protein, 202 aa, Streptococcus pneumoniae
MGKIIGITGGIASGKSTVTNFLKQQGLSTIGLPTHSSTNYRKPGGRLFEALVQHFGQEIILENGELNRPLIASLIFSNPEEQKWSNQIQGEIIREELATLREQLAQTEEIFFMDIPLLFEQDYSDWFAETWLVYVDRDAQVERLMKRDQLSKDEAESRMAAQWPLEKKKDLASQVLDNNGNQNQLLNQVHILLEGGRQDDRD

SEQ ID NO: 5188 - protein, 66 aa, Streptococcus pneumoniae
MGIKGTTKEILAPVRKLPNQAIRRLSFQLISVILPTSLKKDMHLIKKLVLIAIIIKNLAGQIFLFF

SEQ ID NO: 5189 - protein, 399 aa, Streptococcus pneumoniae
MTEINWKDNLRIAWFGNFLTGASISLVVPFMPIFVENLCVWSQQVAFYAGLAISVSAISAALFSPIWGILADKYGRKPMMIRAGLAMTITMGGLAFVPNIYWLIFLRLLNGVFAGFVPNATALIASQVPKEKSGSALGTLSTGVVAGTLTGPFIGGFIAELFGIRTVFLLVGSFLFLAAILTICFIKEDFQPVAKEKAIPTKELFTSVKYPYLLLNLFLTSFVIQFSAQSIGPILALYVRDLGQTENLLFVSGLIVSSMGFSSMMSAGVMGKLGDKVGNHRLLVVAQFYSVIIYLLCANASSPLQLGLYRFLFGLGTGALIPGVNALLSKMTPKAGISRVFAFNQVFFYLGGVVGPMAGSAVAGQFGYHAVFYATSLCVAFSCLFNLIQFRTLLKVKEI

SEQ ID NO: 5190 - protein, 49 aa, Streptococcus pneumoniae
VRVKINLKCSSCGSINYLTSKNSKTHPDKIEVLKYCPKERKVTLHLESK

SEQ ID NO: 5191 - protein, 77 aa, Streptococcus pneumoniae
MYNLLLTILLVLSVVIVIAIFMQPTKNQSSNVFDASSGDLFERSKARGFEAVMQRLTGILVFFWLAIALALTVLSSR

SEQ ID NO: 5192 - protein, 784 aa, Streptococcus pneumoniae
MKDRIKEYLQDKGKVTVNDLAQALGKDSSKDFRELIKTLSLMERKHQIRFEEDGSLTLEIKKKHEITLKGIFHAHKNGFGFVSLEGEEDDLFVGKNDVNYAIDGDTVEVVIKKVADRNKGTAAEAKIIDILEHSLTTVVGQIVLDQEKPKYAGYIRSKNQKISQPIYVKKPALKLEGTEVLKVFIDKYPSKKHDFFVASVLDVVGHSTDVGIDVLEVLESMDIVSEFPEAVVKEAESVPDAPSQKDMEGRLDLRDEITFTIDGADAKDLDDAVHIKALKNGNLELGVHIADVSYYVTEGSALDKEALNRATSVYVTDRVVPMLPERLSNGICSLNPQVDRLTQSAIMEIDKHGRVVNYTITQTVIKTSFRMTYSDVNDILAGDEEKRKEYHKIVSSIELMAKLHETLENMRVKRGALNFDTNEAKILVDKQGKPVDIVLRQRGIAERMIESFMLMANETVAEHFSKLDLPFIYRIHEEPKAEKVQKFIDYASSFGLRIYGTASEISQEALQDIMRAVEGEPYADVLSMMLLRSMQQACYSEHNHGHYGLAADYYTHFTSPIRRYPDLLVHRMIRDYGRSKEIAEHFEQVIPEIATQSSNRERRAIEAEREVEAMKKAEYMEEYVGEEYDAVVSSIVKFGLFVELPNTVEGLIHITNLPEFYHFNERDLTLRGEKSGITFRVGQQIRIRVERADKMTGEIDFSFVPSEFDVIEKGLKQSSRSGRGRGSNRRSDKKEDKRKSGRSNDKRKHSQKDKKKKGKKSFYKEVAKKGAKHGKGRGKGRRTK

SEQ ID NO: 5193 - protein, 155 aa, Streptococcus pneumoniae
MAKGEGKVVAQNKKARHDYTIVDTLEAGMVLTGTEIKSVRAARINLKDGFAQVKNGEVWLSNVHIAPYEEGNIWNQEPERRRKLLLHKKQIQKLEQETKGTGMTLVPLKVYIKDGYAKLLLGLAKGKHDYDKRESIKRREQNRDIARVMKAVNQR

SEQ ID NO: 5194 - protein, 286 aa, Streptococcus pneumoniae
MEKLVAYKRMPLWNKQTMPEAVQQKHNTKVGTWGKITVLKGALKFIELTEEGEVLAEHLFEAGADNPMAQPQAWHRVEAATDDVEWYLEFYCKPEDYFAKKYNTNPVHSEVLEAMQTVKQGKALDLGCGQGRNSLFLAQQDFDVTAVDQNGLALEILQSIVEQEDLDMPVDLYDINSASIEQEYDFIVSTVVLMFLQADRIPAIIQNMQEKTSVGGYNLIVCAMDTEDYPCSVNFPFTFKEGELADYYKDWELVKYNENPGHLHRRDENGNRIQLRFATLLAKKIK

SEQ ID NO: 5195 - protein, 128 aa, Streptococcus pneumoniae
LLKSCKALWSRKIWTCLLTFTISIQLALNKNMILSFQQLFSCFYKRTAFQLLFKICRRKPVLVVTTLSFVPWTRRIILARLTSHSPLKKENWQTITRIGNWLSTMKIQAICTVAMRMAIVFNYALRPY

SEQ ID NO: 5196 - protein, 73 aa, Streptococcus pneumoniae
RKWIWPPQAGQVYACFSSLSSNTFTNSPLVSLATNMNSLLFYIIRKKEKRSGKFLIFMCVYLIFLASKVAKRS

SEQ ID NO: 5197 - protein, 317 aa, Streptococcus pneumoniae
MFVARDTRGELVNVLEDKLEKQAYTCPACGGQIHLRQGPSVRTHFAHKSLKDCDFFFENESPEHIANKESLYHWLKKETKVQLEYPLSELKQIADVFVNGNLALEVQCSPLPQKVLKERSEGYRSQGYQVLWLLGQKLWLKERLTRLQQGFLYFSQNMGFYVWELDKEKQVLRLKYLIYQDLRGKLHYQIKEFSYGQGSLLEILRLPYKRQKISHFTVSEDKDICRYIRQQLYYQNLFWMKEQAEAYQKGENILTYGLKEWYPQIRPIVGKFFQIEQDLTSYYRNFYTYYQKNPQNDWQKLYPPAFYQQYFLKNMVE

SEQ ID NO: 5198 - protein, 600 aa, Streptococcus pneumoniae
MVLQRNEINEKDTWDLSTIYPTDQAWEEALKDLTEQLETVAQYEGHLLDSADNLLEITEFSLEMERQMEKLYVYAHMKNDQDTREAKYQEYYAKAMTLYSQLDQAFSFYEPEFMEISEKQYADFLEAQPKLQVYQHYFDKLLQGKDHVLSQREEELLAGAGEIFGSASETFSILDNADIVFPYVLDDDGKEVQLSHGTYTRLMESKKREVRRGAYQALYATYEQFQHTYAKTLQTNVKVQNYRAKVRNYKSARHAALAANFVPESVYDNLVAAVRKHLPLLHRYLELRSKILGISDLKMYDVYTPLSSVEYSFTYQEALKKAEDALAVLGEDYLSRVKRAFSERWIDVYENQGKRSGAYSGGSYDTNAFMLLNWQDNLDNLFTLVHETGHSMHSSYTRETQPYVYGDYSIFLAEIASTTNENILTEKLLEEVEDDATRFAILNNFLDGFRGTVFRQTQFAEFEHAIHQADQNGEVLTSDFLNKLYADLNQEYYGLSKEDNPEIQYEWARIPHFYYNYYVYQYSTGFAAASALAEKIVHGSQEDRDRYIDYLKAGKSDYPLNVMRKAGVDMEKEDYLNDAFAVFERRLNEFEALVEKLGLA

SEQ ID NO: 5199 - protein, 237 aa, Streptococcus pneumoniae
MVESYSKNANHNMRRPVVKEEIVDLMRQRQKQVTGFLKELEDFARKENIPIIPHETVAYFRFLMETMQPKNILEIGTAIGFSALLMAEHAPNAKITTIDRNPEMIGFAKENFAQFDSRKQITLLEGDAVDVLSTLTESYDFVFMDSAKSKYIVFLPEILKHLEVGGVVVLDDIFQGGDVAKDIMEVRRGQRTIYRGLQKLFDATLDNPELTATLVPLGDGILMLRKNVADVQLSESE

SEQ ID NO: 5200 - protein, 313 aa, Streptococcus pneumoniae
MKKKLLAGAITLLSVATLAACSKGSEGADLISMKGDVITEHQFYEQVKNNPSAQQVLLNMTIQKVFEKQYGSELDDKEVDDTIAEEKKQYGENYQRVLSQAGMTLETRKAQIRTSKLVELAVKKVAEAELTDEAYKKAFDEYTPDVTAQIIRLNNEDKAKEVLEKAKAEGADFAQLAKDNSTDEKTKENGGEITFDSASTEVPEQVKKAAFALDVDGVSDVITATGTQAYSSQYYIVKLTKKTEKSSNIDDYKEKLKTVILTQKQNDSTFVQSIIGKELQAANIKVKDQAFQNIFTQYIGGGDSSSSSSTSNE

SEQ ID NO: 5201 - protein, 113 aa, Streptococcus pneumoniae
MLEQAFKEKHYENTILHSDQGWQYQHDSYHRFLESKGIQASMSRKGNSQDNGRMESFFGILKSEMFYGYEQTFKSLNQLEQAIIDYIDYYNNKRIKIKLKGLSSVQYRTKSFG

SEQ ID NO: 5202 - protein, 190 aa, Streptococcus pneumoniae; identical to SEQ ID NO: 2680

SEQ ID NO: 5203 - protein, 90 aa, Streptococcus pneumoniae
KQLCTILDSLFYTKMSREEKVKVYAQTLHIRTLAYPFYGILHYPLKLPDSYPSKIYSNHVSFTLYMLVTSQVLSATSKLFFEQPTASFLV

SEQ ID NO: 5204 - protein, 63 aa, Streptococcus pneumoniae
IDLNSQIILFSSYFILLYNPVEKTRVHIKKVLASCNTFLRGSFILFLFQLTISPMVLVQKARL

SEQ ID NO: 5205 - protein, 206 aa, Streptococcus pneumoniae
MKLYFVRHGRTLWNQEGRFQGASGDSPLLPESIETLKRLGQYLKEIPFDQIYSSDLPRAVKSAEIIQSQLYTPCSLEIVPNLREWQLGKLEGLKIATLEAIYPQQIQAFRSNLAQFDTRMFGAESLYSTTQRTIQFIKSLKDSPAERILIVGHGANLTASLRTLLGYKEPLLRKDGGLANASLTIIETHDFETFTLNTWNDTSYQS

SEQ ID NO: 5206 - protein, 160 aa, Streptococcus pneumoniae
MAKKVKIKKTLVEQILSKAAIPHQGIQINALEGELPQGYERDQIFKTLALLGDKTGPIIGIVPITQHLSEKKLAKISGNKKVSMIPQKDLEKTTGYIHGANNPVGIRQKHNYPIFIDKIALDLDRMIVSAGEVGHSIIVAPQDLASFVKADFVDILEDIK

SEQ ID NO: 5207 - protein, 280 aa, Streptococcus pneumoniae
MLSWLARVIKGIVIALGFILPGISGGVLAAILGIYERMIGFLAHPFKDFKENVLYFIPVAIGMLLGIGLFSYPIEYLLENYQVFVLWSFAGAIIGTVPSLLKESTRESDRDKIDLAWLWTTFIISGLGLYALNFVVGTLSASFLNFVLAGALLALGVLVPGLSPSNLLLILGLYAPMLTGFKTFDLLGTFFPIGIGAGATLIVFSKLMDYALNNYHSRVYHFIIGIVLSSTLLILIPNAGNAESIQYTGLSLVGYVIIAFFFALGIWLGIWMSQLEDKYK

SEQ ID NO: 5208 - protein, 262 aa, Streptococcus pneumoniae
MRKQIHPLILFSFFGIMMFILIINRPLNDSQSFKTKSNIAQALKHLDKPIIDLSGWQRPEEINYDALSQNISGAIVRVHSGAQTTKENDASFINGIDKAYKSHITELQKRNVPVAVYAYVAGKSVQEMEKAAEVFYNAASPYSPSYYWLDVENKTMSNMNEGVENFRAKLASLGAKNIGIYVGVYFMEETRIDTGKFTSVWIPSYGSNSGFLESSPKTDLDYDIHQYTSKGKIAGFDHDLDINVISPLKNKEETFRKLFLKP

SEQ ID NO: 5209 - protein, 459 aa, Streptococcus pneumoniae
MSNFAIILAAGKGTRMKSDLPKVLHKVAGISMLEHVFRSVGAIQPEKTVTVVGHKAELVEEVLAGQTEFVTQSEQLGTGHAVMMTEPILEGLSGHTLVIAGDTPLITGESLKNLIDFHINHKNVATILTAETDNPFGYGRIVRNDNAEVLRIVEQKDATDFEKQIKEINTGTYVFDNERLFEALKNINTNNAQGEYYITDVIGIFRETGEKVGAYTLKDFDESLGVNDRVALATAESVMRRRINHKHMVNGVSFVNPEATYIDIDVEIAPEVQIEANVILKGQTKIGAETVLTNGTYVVDSTIGAGAVITNSMIEESSVADGVTVGPYAHIRPNSSLGAQVHIGNFVEVKGSSIGENTKAGHLTYIGNCEVGSNVNFGAGTITVNYDGKNKYKTVIGVNVFVGSNSTIIAPVELGDNSLVGAGSTITKDVPADAIAIGRGRQINKDEYATRLPHHPKNQ

SEQ ID NO: 5210 - protein, 181 aa, Streptococcus pneumoniae
MEFEEKTLSRKEIYQGPIFKLVQDQVELPEGKGTARRDLIFHNGAVCVLAVTDEQKLILVKQYRKAIEAVSYEIPAGKLEVGENTAPVAAALRELEEETAYTGKLELLYDFYSAIGFCNEKLKLYLASDLTKVENPRPQDEDETLEVLEVSLEEAKELIQSGHICDAKTIMAVQYWELQKK

SEQ ID NO: 5211 - protein, 104 aa, Streptococcus pneumoniae
MGKSLLTDEMIERANRGEKISGPPLLDDNEETKILPTSSSRFGYANPKDHGFSQETLKIQVEPSIHKSRRIENTKRNVFNSKLNKILFAVIFLLILLVLAMKLL

SEQ ID NO: 5212 - protein, 230 aa, Streptococcus pneumoniae
MKIGIIAAMPEELAYLVQHLDNTQEQVVLRNTYHTGTIASHEVVLVESGIGKVMSAMSVAILADHFQVDALINTGSAGAVAEGIAVGDVVIADKLAYHDVDVTAFGYAYGQMAQQPLYFESDKTFVAQIQESLSQLDQNWHLGLIATGDSFVAGNDKIEAIKSHFPEVLAVEMEGAAIAQAAHALNLPVLVIRAMSDNANHEANIFFDEFIIEAGRRSAQVLLTFLKALD

SEQ ID NO: 5213 - protein, 163 aa, Streptococcus pneumoniae
MSIEMTVSEIAEVLGLSRQAINNRVKELPEEDTDKNDKGVTVVTRSGLIKLEEIYKKTIFEDEPVSEDVKQRELMEILVDEKNAEILRLYEQLKAKDRQLSEKDEQMRIKDRQIAEKDKQLDQQQQLTLQAMKDQENLKLELDQAKEEVQSTKKGFFARLFGG

SEQ ID NO: 5214 - protein, 196 aa, Streptococcus pneumoniae
MERLEDYIAFDLEFNQHEGQTHLIQVSAVRFRDGREIDAYDSYVHTSVPLKSFINGLTGITAETLKDAPPVEKVLEEFQEFVGSLLMIGYNAAKSDLPILAEHGLDYSQQYKVDLYDEAFERRSSDLHGIANLKLQTVASFLGFQGQSHNSLEDARMTARVYESFLESDQARELLETESSLSNNPFGGLDLSQLFD

SEQ ID NO: 5215 - protein, 256 aa, Streptococcus pneumoniae
MVHLPQLISHRGVSNANGIQNTVESLETTAQLKPDLVETDVQETKDGQFVMMHDANLKNLAGINKSPQDLNLEELKGIDIFENGYQTKISSFEDYLSRANELGQKLLIEIKTSKKDSPDMMNRFLARYAAMLKIYGHQIQSLDYHVVEKVRQYDAELPVYFIMPYNSVFPKTRATGYTMEYSTLDEYFVSKLWTTDQKLYVWTVNDSEAISKSLHLGVDGVITDDLEKVQREIEVAQEDPEYTDLLLKKALEFFEF

SEQ ID NO: 5216 - protein, 115 aa, Streptococcus pneumoniae; identical to SEQ ID NO: 4727

SEQ ID NO: 5217 - protein, 46 aa, Streptococcus pneumoniae
LVAGLTNGELIAPMTYEEMMTSDFFEVWFQKFFLPTLTTPSVIIVK

SEQ ID NO: 5218 - protein, 66 aa, Streptococcus pneumoniae
VVASASASSTSTQAQEQVDKSELRALSQELDQRLKALATISDPKIDATKAVLLDAQKAPEDSALTE

SEQ ID NO: 5219 - protein, 210 aa, Streptococcus pneumoniae
MFYLSLSRIALSSSTSLVSVSAEPFSSFTKSRVSWRRFWALARTFLSAFSASSCPRTLINSVLNCWISDSFLRRISQKAITPRRASRLTTITPAGTEFVSVILSESLLSSVPCFASFLSCAGLLSLAFAFTSLRESKAAQPSQTLLQYADLTLSRHYLPELFEHLGGQPWLHRFSDQILLPKLSSVGLTLDSRHEVQTCQLALELVCSLS

SEQ ID NO: 5220 - protein, 99 aa, Streptococcus pneumoniae
MTETNSVPAGVIVVSLLALLGVIAFWLIRRKKESEIQQLSTELIKVLGQLDAEKADKKVLAKAQNLLQETLDFVKEENGSAETETKLVEELKAILDKLK

SEQ ID NO: 5221 - protein, 235 aa, Streptococcus pneumoniae
LETIVFLISVFLAGVLSFFSPCIFPLLPVYAGILLDDQESAKSFSLFGRKVLWSGLIRTLCFIAGISLIFFILGFGAGYFGHILYANWFRYGMGAIIIILGLHQMEIFHLKKLEVQKSFTFKKSDSNRYWSAFLLGITFSFGWTPCIGPVLSSVLALAASGGNGAWQGAIYTLIYTLGMALPFLVLALASGLVMPYFSKIKRHMMLLKKIGGFLIVLMGILLLLGQVNVLAGIFE

SEQ ID NO: 5222 - protein, 185 aa, Streptococcus pneumoniae
MKKVMFAGLSLLSLVVLMACGEEETKKTQAAQQPKQQTTVQQIAVGKDAPDFTLQSMDGKEVKLSDFKGKKVYLKFWASWCGPCKKSMPELMELAAKPDRDFEILTVIAPGIQGEKTVEQFPQWFQEQGYKDIPVLYDTKATTFQAYQIRSIPTEYLIDSQGKIGKIQFGAISNADAEAAFKEMN

SEQ ID NO: 5223 - protein, 463 aa, Streptococcus pneumoniae
MNIFRTKNVSLDKTEMHRHLKLWDLILLGIGAMVGTGVFTITGTAAATLAGPALVISIVISALCVGLSALFFAEFASRVPATGGAYSYLYAILGEFPAWLAGWLTMMEFMTAISGVASGWAAYFKGLLSQYGIAFPQALNGTFNPQAGTFVDLLPILVLVLVTSLVLLNAKAALRFNSILVILKFSALALFVLVGIWNIKFDNWSNFAPYGFGQIYGASTGIMAGASLMFFGFLGFESISMAVDEVKTPQKNIPRGIVLSLSIVTILYALVTLVLTGVVHYSHLNVDDAVAFALRSVGISWAANYVSLVAILTLITVCISMTYALSRMIYSLARDGLVPAAFKELTKTSKIPKNATILTGLASAVAAGMFPLASIAAFLNICTLAYLIMLAYGLIRLRKEKGMPKAGEFKTPLVPLLPILSIIICLSFMLQYNMNTWIAFLVALLVGSIIYFTYGYKHSTIEE

SEQ ID NO: 5224 - protein, 307 aa, Streptococcus pneumoniae
  UNSURE (203): Xaa at each above location is unknown.
LFMKKQNLFLVLLSVFLLCLGACGQKESQTGKGMKIVTSFYPIYAMVKEVSGDLNDVRMIQSSSGIHSFEPSANDIAAIYDADVFVYHSHTLESWAGSLDPNLKKSKVKVLEASEGMTLERVPGLEDVEAGDGVDEKTLYDPHTWLDPEKAGEDTQIIADKLSEVDSEHKETYQKNAQAFIKKAQELTKKFQPKFEKATQKTXVTQHTAFSYLAKRFGLNQLGIAGISPEQEPSPRQLTEIQEFVKTYKVKTIFTESNASSKVAETLVKSTGVGLKTLNPLEADPQNDKTYLENLEENMSVLAEELK

SEQ ID NO: 5225 - protein, 838 aa, Streptococcus pneumoniae
MKINKKYLAGSVAVLALSVCSYELGRHQAGQVKKESNRVSYIDGDQAGQKAENLTPDEVSKREGINAEQIVIKITDQGYVTSHGDHYHYYNGKVPYDAIISEELLMKDPNYQLKDSDIVNEIKGGYVIKVDGKYYVYLKDAAHADNIRTKEEIKRQKQEHSHNHNSRADNAVAAARAQGRYTTDDGYIFNASDIIEDTGDAYIVPHGDHYHYIPKNELSASELAAAEAYWNGKQGSRPSSSSSYNANPVQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEQPSPQSTPEPSPSLQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEVLDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHVRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQ

SEQ ID NO: 5226 - protein, 1039 aa, Streptococcus pneumoniae
MKFSKKYIAAGSAVIVSLSLCAYALNQHRSQENKDNNRVSYVDGSQSSQKSENLTPDQVSQKEGIQAEQIVIKITDQGYVTSHGDHYHYYNGKVPYDALFSEELLMKDPNYQLKDADIVNEVKGGYIIKVDGKYYVYLKDAAHADNVRTKDEINRQKQEHVKDNEKVNSNVAVARSQGRYTTNDGYVFNPADIIEDTGNAYIVPHGGHYHYIPKSDLSASELAAAKAHLAGKNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 5227 - protein, 62 aa, Streptococcus pneumoniae
NSPKVRVLFLTFERTSFLIQTFSTAIPYAMKSDKFFFITSPLGNLNSIVPSILNITLSKPNP

SEQ ID NO: 5228 - protein, 62 aa, Streptococcus pneumoniae
VSQKEGIQAKQIVIKITDQGYVTSHGDHYRYYNGKVPFDALFSEELLMKAPNYQPKDQDIVS

SEQ ID NO: 5229 - protein, 66 aa, Streptococcus pneumoniae
VKGGYIIKVDGKYYVYLKDQAHAENVRTKDEINRQKQEHGKDDKGASAEVSVAKLQGRYTTDDGYI

SEQ ID NO: 5230 - protein, 160 aa, Streptococcus pneumoniae
LSVTPNNGVSAADDGYVFNPNDIVRDTGDAYIVRHGDHYHYIPKSSLNNPPSHSNTEEAGSSSSSVLSNPSLHVHHEEEDGHGFDANRIISEDSEGFVIPHGDHNHYIKVQTKGYEAALKNKIPSLQSNYQPGTFDEKAVLAKVDQLLADSRSIYKDRLS

SEQ ID NO: 5231 - protein, 79 aa, Streptococcus pneumoniae
LSDSFFMDLFQELICLAQKTFYFFLAICRRLLVAIYHVLLKQESYNPRLQGLTEIRNPDKTMFVQDAIRFAQQHGFNML

SEQ ID NO: 5232 - protein, 85 aa, Streptococcus pneumoniae
LSKANQLLEQIHEEGIRQSLAEEVENLKAATNKVDADLDEVNSQVKDVLTRIASALQQEKENAEQDSQTLVLYQKLYDILMSLRK

SEQ ID NO: 5233 - protein, 144 aa, Streptococcus pneumoniae
MLSKILRHLYSIKNSTIFSCRLESNNGSDADFDKVDALLDQLSANSKDKTALLESTKAILVLNHQIQSKASASEETSPARNAEANGDNTSAENQPNATAESNIETASDENKPSNTRDSKPAESTSENKTTESSTTTGNQEKPVE

SEQ ID NO: 5234 - protein, 407 aa, Streptococcus pneumoniae
MTYPNLLDRFLTYVKVNTRSDEHSTTTPSTQSQVDFATNVLIPEMKRVGLQNVYYLPNGFAIGTLPANDPSLTRKIGFISHMDTADFNAEGVNPQVIENYDGGVIELGNSGFKLDPADFKSLEKYPGQTLITTDGTTLLGADDKSGIAEIMTAIEYLTAHPEIKHCEIRVGFGPDEEIGVGANKFDAEDFDVDFAYTVDGGPLGELQYETFSAAGAELHFQGRNVHPGTAKGQMVNALQLAIDFHNQLPENDRPELTEGYQGFYHLMDVTGSVEEARASYIIRDFEKDAFEARKASMQSIADKMNEELGSNRVTLNLTDQYYNMKEVIEKDMTPITVAKAVMEDLGITPIIEPIRGGTDGSKISFMGIPTPNIFAGGENMHGRFEYVSLQTMERAVDTIIGIVAYKG

SEQ ID NO: 5235 - protein, 364 aa, Streptococcus pneumoniae
MKKAILMMTFGSPEEITFEGVADFFTNIRRGVRPQDHEIQTLYDNYVRIGGTPLQKITRQEVALVEARLGNEYSVYFANKFSSPFIPDVIGQMEADGIEQCICLILEPHYSFYSVMGYEKFLESKQIQFLVIKDWYQEEALLNYWVDEIAKILKEEVKQDSCKVIFSAHSVPIFALDFGDPYIDQIFENSKLVAEKLGLSSEQYTNTWQSESDIGIPWIKPDVLEYLREQTEHPDHYIFVPISFISEHIEVLFDNDVECYDLCQEFGVNYHRPPMPNTDSRLIDALVNTVRVNENQEFKEFLPEEETFDELVPSDETKNILAESEDLQMPEFVKKLIEKKGRENVKMPYLIKKMLEKAGKLPKE

SEQ ID NO: 5236 - protein, 125 aa, Streptococcus pneumoniae
MLKNLKSFLLRGNVIDLAVGVVIASAFGAIVTSLVNDIITPLILNPALKAAKVERIAQLSWHGVGYGNFLSAIINFIFVGTALFFIIKGIEKAQKLTGIKKEKTAEKKPTELEVLQEIKALLEKK

SEQ ID NO: 5237 - protein, 86 aa, Streptococcus pneumoniae
SQIDPVVFKPKKENSFIRLRKIFSCWPFYFSVRLVFNFFLVTQFPHIIGQFVTENIDKIKAIETIIAQIFIIIINYILSKAYIFRK

SEQ ID NO: 5238 - protein, 128 aa, Streptococcus pneumoniae
MMSQKIIGIDLGGTSIKFAILTTAGEIQGKWSIKTNILDEGSHIVDDMIESIQHRLDLLGLAAADFQGIGMGSPGVVDRDKGTVIGAYNLNWKTLQPIKQKIEKALGIPFFIDNDANVAALGERWMGA

SEQ ID NO: 5239 - protein, 87 aa, Streptococcus pneumoniae
MVKWLSMNGLMVDVIMLALTEFGRKVKQVQFLLVMIAIVNISAALGKAKSYNSLFHMSKKRMYRQLTSDFDKFSNDAAQYAIDHLDN

SEQ ID NO: 5240 - protein, 272 aa, Streptococcus pneumoniae
LSTIDKSGVLPFSAQTVQADIQTLTPMAKYYIILPKDAEIYKTWRGTVNIPIIDATKTTPELSYFKEDHRNYIANENKSGANYIEWKGTVEEFKEAIKKLTDKKSTTATPKKDEKPTPKPDEKPKPTPTVQSGWVGSSYYQDGKKVISKWIFDKKYNSYFYLDASGNYVQNAWVGNYYLKSGGYMAKGEWVYDATYQAWYYLTSDGSYAYSTWQGNYYLKSDGKMAVNEWVDGGRYYVGADGVWKEGQASTVSSSNDSNSEYFCCFRKGKKL

SEQ ID NO: 5241 - protein, 509 aa, Streptococcus pneumoniae
LMKSKIVLGASLAIATLSLVSLVEIEGLSPFLIENVSANTHSANKVINHKVSIYLENADEGKGLTVNFSTDSVSPNLFDEFEKKSGITITTMLVNAKTGEVVEKRLTPSVFLRSNDLTSGTISSFIFSEYPDGEYKYVVSKGDFIDPKTQFKHQYRGESPVFRIRNRKYVELGTTDKKLDERRDNSVYKDGVVEHKVNLSLTSYQGGNGVTAIFSTDSVNSNLLNSFGEKAKKVLIRSKLINVKTGEVIDETFSPKVSLTSKILKSGSTAVFYFIDLTDGEYKYVAYESQQYTDPQTTLTHQYRGESPIFSIKDGKFSGLVSASKPDENPKPTPKPDEKPKPSAPQQEKPKPTVQSGWVGSSYYQNGKKVTSKWIFDKKYNSYFYLDASGNYVQNAWVGNYYLKSGGYMAKSEWIYDKNYGSYYYLTSEGSYARNTWSGNYYLKSNGKMAKSEWVYDSNYKSYYYLTSEGSYARNTWVGNYYLKSNGKMAVNERTPDGYRVDGSGKWVK

SEQ ID NO: 5242 - protein, 573 aa, Streptococcus pneumoniae
MHRKTVIDFRTLGERYTFTKPIKELKTRNVEEVADLLAQVESYQEQGYYVVGYVSYEAAPAFEEKLAVHKDPLLGEYLLYFTVHDSVETSSIPLTYEDIDLPSNWQEVTSAADYEKAIAQIHHHLRQGDTYQVNYTVQLKQKLNANPFAIYNRMVVEQEAGYNAYVEHDEMAVISMSPELFFEQNDRELTTRPMKGTTQRGVTDQEDLEQASWLEQDPKNRSENMMIVDLLRNDMNRISEVGSEHVERLCQVEQYSTVWQMTSTIKSQLREDVDLVEIFRSLFPCGSITGAPKIATMEIIKDLEPQPRGVYCGTIGLLLPNGRRIFNVAIRTIQLHKGQAIYGVGGGITWDSTWESEYREVHQKAAVLYRKQARFQLITTGEISQKNLLFEDQHLERLRKASRYFAFPFDAEDLGHKIEEECQDCEANRDYRLRISLSKSGEIEVNRQVLTPLSTSFCQAQVCLQEAALNQSFTYFKTTHRPHLSLGEQEKIYHNKSGELLETSIGNLVLKIAGKLYTPPIRLGILPGIYRQYLLETGQVEEKVLTLADLAQAEAIYGCNAVRGLYELQVIGL

SEQ ID NO: 5243 - protein, 1963 aa, Streptococcus pneumoniae
VFKKDRFSIRKIKGVVGSVFLGSLLMAPSVVDAATYHYVNKEIISQEAKDLIQTGKPDRNEVVYGLVYQKDQLPQTGTEASVLTAFGLLTVGSLLLIYKRKKIASVFLVGAMGLVVLPSAGAVDPVATLALASREGVVEMEGYRYVGYLSGDILKTLGLDTVLEETSAKPGEVTVVEVETPQSTTNQEQARTENQVVETEEAPKTEESPKEEPKSEIKPTDDTLPKVEEGKEDSAEPAPVEEVGGEVESKPEEKVAVKPESQPSDKPAEESKVEPPVEQAKGPEQPVQPTQAEQPRIPKDSSQPEDPKEDRGAEDTPKQEDTQPEVVETKDEAANQPVEEPKVETPAVEKQTEPKVEQVGEPVEPSEDEKAPVSPEKQPEAPEEKAVEETPKPEDKIKGIGTKEPVDKSELNNQIDKASSVSPTDYSTASYNALGPVLETAKGVYASEPVKQPEVNSETNKLKTAIDALNVDKSELQEQLRVAEQKQQADYSAKTWREFKIAELQAKEINNQTTPLPKQSEIDAATKALQDALQALAVDKTVLQNAINTANSKREEEYTAQTWKALEDALTAVNPVNEDETATQSKVDEATRNLEEAINNLVLLTEKPVLTFIETDKKALEREVVAKYSLENQNKTKIKSITATLKKGETVVSTVELIGDDVTNETITSAFKNLEYYKEYTLSTTMVYDRGDGDVTEILDNQPIQLDLKKVELKNIKRTDLIKYENGKETNESLITTVPDDKRNYYLKITSKNQKTTLLAVKNIEETTVNGTPVYKVTAIADNLVSRTADNKFEEEYVHYIEKPKVHEDNVYYNFKELVEAIQNDPSKEYRLGQSMSARNVVPNGKSYITKEFTGKLLSSEGKQFAITELEHPLFNVITNATINNVNFENVEIERSGQDNIASLANTMKGSSVITNVKITGTLSGRNNVAGFVNNMNDGTRIENVAFFGKLHSTSGNGSHTGGIAGTNYRGIVRKAYVDATITGNKTRASLLVPKVDYGLTLDHLIGTKALLTESVVKGKIDVSNPVEVGAIASKTWPVGTVSNSVSYAKIIRGEELFGSNDVDDSDYASAHIKDLYAVEGYSSGNRSFRKSKTFTKLTKEQADAKVTTFNITADKLESDLSPLAKLNEEKAYSSIQDYNAEYNQAYKNLEKLIPFYNKDYIVYQGNKLNKEHHLNTKEVLSVTAMNNNEFITNLDEANKIIVHYADGTKDYFNLSSSSEGLSNVKEYTITDLGIKYTPNIVQKDNTTLVNDIKSILESVELQSQTMYQHLNRLGDYRVNAIKDLYLEESFTDVKENLTNLITKLVQNEEHQLNDSPAARQMIRDKVEKNKAALLLGLTYLNRYYGVKFGDVNIKELMLFKPDFYGEKVSVLDRLIEIGSKENNIKGSRTFDAFGQVLAKYTKSGNLDAFLNYNRQLFTNIDNMNDWFIDATEDHVYIAERASEVEEIKNSKHRAFDNLKRSHLRNTILPLLNIDKAHLYLISNYNAIAFGSAERLGKKSLEDIKDIVNKAADGYRNYYDFWYRLASDNVKQRLLRDAVIPIWEGYNAPGGWVEKYGRYNTDKVYTPLREFFGPMDKYYNYNGTGAYAAIYPNSDDIRTDVKYVHLEMVGEYGISVYTHETTHVNDRAIYLGGFGHREGTDAEAYAQGMLQTPVTGSGFDEFGSLGINMVFKRKNDGNQWYITDPKTLKTREDINRYMKGYNDTLTLLDEIEAESVISQQNKDLNSAWFKKIDREYRDNNKLNQWDKIRNLSQEEKNELNIQSVNDLVDQQLMTNRNPGNGIYKPEAISYNDQSPYVGVRMMTGIYGGNTSKGAPGAVSFKHNAFRLWGYYGYENGFLGYASNKYKQQSKTDGESVLSDEYIIKKISNNTFNTIEEFKKAYFKEVKDKATKGLTTFEVNGSSVSSYDDLLTLFKEAVKKDAETLKQEANGNKTVSMNNTVKLKEAVYKKLLQQTDSFKTSIFK

SEQ ID NO: 5244 - protein, 77 aa, Streptococcus pneumoniae
LFNSLLSTGSLVPIPFILSSGFGVSSTAFSSGASGCFSGETGAFSSSLGSTGSPTCSTFGSVCFSTAGVSTFGSSTG

SEQ ID NO: 5245 - protein, 107 aa, Streptococcus pneumoniae
TFINWFFSTNTLYFIFWFRCFLYSLLFRSFWLLFWRDWCLFVFTWLDWFTYLFNFWFRLFFYSRRFNFWFFNRLISSLIFCFYYFWLCIFLFRCIFRSPIFFRIFWL

SEQ ID NO: 5246 - protein, 187 aa, Streptococcus pneumoniae
MNETQIQRETRQVVEDVLEKTNLKQGALFVLGLSSSEVLGGQIGKESSQEIGELIVETILGILSSRGIHLAVQGCEHVNRALVVERQVAEQFGLEIVSVHPTLHAGGSGQLAAFKFMQDPVEVEFIKAHAGLDIGDTAIGMHVKHVQVPIRPILREIGHAHVTALASRPKLIGGARAHYPQDAIRKS

SEQ ID NO: 5247 - protein, 377 aa, Streptococcus pneumoniae
NSGSLSQSTPVGAAGFAFIINENHEFVYHPQHTVYSSSSKMEAMKPYIDTGQGYTPGHKSYVSQEKIAGTDWTVLGVSSLEKLDQVRSQLLWTLLGASVTSLLVCLCLVWFSLKRWIAPLKDLRETMLEIASGAQNLRAKEVGAYELREVTRQFNAMLDQIDQLMVAIRSQEETTRQYQLQALSSQINPHFLYNTLDTIIWMAEFHDSQRVVQVTKSLATYFRLALNQGKDLICLSDEINHVRQYLFIQKQRYGDKLEYEINENVTFDNLVLPKLVLQPLVENALYHGIKEKEGQGHIKLSVQKQDSGLVIRIEDDGVGFQDAGDSSQSQLKRGGVGLQNVDQRLKLHFGANYQMKIDSRPQKGTKVEIYINRIETS

SEQ ID NO: 5248 - protein, 62 aa, Streptococcus pneumoniae
LLMQREPILVCFVWIFLHETLEAYLNQLQLGQQALPSLSMKTMNLSTILNTQFIVRLAKWRL

SEQ ID NO: 5249 - protein, 185 aa, Streptococcus pneumoniae
MKRSSLLVRMVISIFLVFLILLALVGTFYYQSSSSAIEATIEGNSQTTISQTSHFIQSYIKKLETTSTGLTQQTDVLAYAENPSQDKVEGIRDLFLTILKSDKDLKTVVLVTKSGQVISTDDSVQMKTSSDMMAEDWYQKAIHQGAMPVLTPARKSDSQWVISVTQELVDAKGANLGVLRLDISS

SEQ ID NO: 5250 - protein, 245 aa, Streptococcus pneumoniae
MTYTILIVEDEYLVRQGLTKLVNVAAYDMEIIGQAENGRQAWELIQKQVPDIILTDINMPHLNGIQLASLVRETYPQVHLVFLTGYDDFDYALSAVKLGVDDYLLKPFSRQDIEEMLGKIKQKLDKEEKEEQLQDLLTNRFEGNMAQKIQSHLADSQFSLKSLASDLGFSPTYLSSLIKKELGLPFQDYLVRERVKQAKLLLLTTDLKIYEIAEKVGFEDMNYFTQRFKQIAGVTPRQFKKGEDR

SEQ ID NO: 5251 - protein, 370 aa, Streptococcus pneumoniae
MNDKLKIFLLLGVFFLAITGFYVLLIRNAGQTDASQIEKAAVSQGGKAVKKTEISKDADLHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKTFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYVD

SEQ ID NO: 5252 - protein, 197 aa, Streptococcus pneumoniae
LNKMERNINMKKWQTCVLGAGSLLCLTACSGKSVTSEHQTKDEMKTEQTASKTSAAKGKEVADFELMGVDGKTYRLSDYKGKKVYLKFWASWCSICLASLPDTDEIAKEAGDDYVVLTVVSPGHKGEQSEADFKNWYKGLDYKNLPVLVDPSGKLLETYGVRSYPTQAFIDKEGKLVKTHPGFMEKDAILQTLKELA

SEQ ID NO: 5253 - protein, 236 aa, Streptococcus pneumoniae
MGHIFFFLSVFLAGILSFFSPCILPLLPVYTGVLLDDKDGAQASSGKFSISVTSLLRTLAFIAGISFIFILLGYGAGFLGDLLYASWFQYLTGAIIILLGLHQMEILHFKELYKEKRLQLQGQGQNGKGYSQAFLLGLTFSFAWTPCVGPVLGSVLALAASGGSGAWQGAGLMLVYTLGLALPFLLLALTSSYVLKHFRKLHPYLGILKKVGGFLIIVMGLLVLFGNASILSQLFE

SEQ ID NO: 5254 - protein, 286 aa, Streptococcus pneumoniae
MKKWWKELIDKPLLKAFLHYYQASDSELTSVAVAYYWLISIFPLLLVVVNILPYFQIPVGEFLGFMKDVLPPSLYEGVEKIAREVLTQPSTGLLSFSVLSALWSFSKSMNFLQKAFNKAYGVEKSRGLISHQMLSLLVSFGLQILFAFALFLILFGQMILALLAHYWTKDGIIYQALQGLAGPLIYALLFAILVMLYYFLPNLSNRKISYTLPGSAFVLLVILGLLTLFSSYLNYYVHHLVDVRILGSVLLVVMMFWFILIAKIVILGAVINASMQSLKDPVFKKD

SEQ ID NO: 5255 - protein, 684 aa, Streptococcus pneumoniae
VELLIYLILFLLVLIVSSTTNKLLPFLPLPLVQILLGIVIGLFLPNTDFHLNTELFLALVIGPLLFREAEEADVTAILKHWRIIVYLIFPVIFISTLSLGGLAHLLWFSLPLAACLAVGAALGPTDLVAFASLSERFSFPKRVSNILKGEGLLNDASGLVAFQVALTAWTTGAFSLGQASSSLIFSILGGFLIGFLTAMTNRFLHTFLLSVRATDIASELLLELSLPLVTFFLAEEVHVSGIIAVVVAGILKASRFKKITLLEAQVDTVTETVWHTVTFMLNGSVFVILGMELEMIAEPILTNPIYNPLLLLLSLIALTFVLFVIRFIMIYGYYAYRTRRLKKKLNKYMKDMFLLTFSGVKGTVSIATILLIPSNLEQEYPLLLFLVAGVTLVSFLTGLLVLPHLSDEEEESKDYLMHIAILNEVTLELEKELEDTRNKLPLYAAIDNYHGRIENLILSQENQDDQEDWAALKLLILSIESDGLEQAYEEGNISNRVYRVYQRYLKNIEQGINRKLASRLTYYFLVSLRILRFLLHEVFTLGKTFRSWKNKEQSRLRALDYDQIAELYLANTEMIIESLENLKGVYSRSLISFMQESRLRETTIISSGAFVERVINRVKPNNINEMLRGYYLERKLIFEYEEKRLITTKYAKKLRQNVNNLENYSLKEAANTLPYDMVELVRRN

SEQ ID NO: 5256 - protein, 63 aa, Streptococcus pneumoniae
LLLKWNGAREKLSTKTVPRLTKKSKSRRRYLNPVVKKIKEDVRGITDLPHPIFTGFDCLKYNQ

SEQ ID NO: 5257 - protein, 84 aa, Streptococcus pneumoniae
MDKQYLHEKLDAMRQNFVESTHHERAVGVLDQAHMSKKMLKIKKKLVALEMERCQRKIEHKDCSKIDQKIKEQKEIFESCCKKD

SEQ ID NO: 5258 - protein, 62 aa, Streptococcus pneumoniae
AFFCSYALGLARPPLVRGGLIQQNSGAWHPAFRVGIVYPCLYLSNFSIITKNGGLLTWFKVR

SEQ ID NO: 5259 - protein, 187 aa, Streptococcus pneumoniae
LKMKRPLEMAHDFLAEVVTKEDVVVDATMGNGHDTLFLAKLAKQVYAFDIQKQALEKTQERLHQADLTNAQLILQGHETLDQFVIKAKAGIFNLGYLPSADKSVITRPQTTIEALEKLCGLLVKGGRIAIMIYYGHEGGDLERDAVLDFVIQLNQQEYTAAIYRTLNQVNNPPFLVMIEKLERYRHG

SEQ ID NO: 5260 - protein, 148 aa, Streptococcus pneumoniae
VETVKRLRKYPKIEIVSHLINGLPGETHEMMVENVRRCVTNNDIQGIKLHLLHLMTNTRMQRDYHEGRLQLMSQDEYVRVICDQLEIIPKHIVIHRITGDAPRDMLLGPMWSLNKWEALNSIEMEMRRRGSVQGCKAVKQEFENEKTT

SEQ ID NO: 5261 - protein, 83 aa, Streptococcus pneumoniae
FYKEIDFIHRKWPDVQKYLVYFQNFTNTREKVEVIRERYEQAINEPGVVGINIGTRPDCLPDETIEYLAELSECMHVTVELGL

SEQ ID NO: 5262 - protein, 145 aa, Streptococcus pneumoniae
YSNTKTGKAKSAKFRPSFFNLKSLVRIMQTTKVSINNKIDANFIKIIPILYHKKRLMETRNRGIYRKVRLLRLWVIFVIMKVIKSYNTLNDYYRKLFGEKTFKVPIDAGFDCPNRDGTVAHGGCTFCTVSGSGDAIVAPDAPIRE

SEQ ID NO: 5263 - protein, 119 aa, Streptococcus pneumoniae
MGMILMKLASILLLILTLVVCIILTKLFRLKKLGRNFADLAFPVLVFEYYLITAKTFTHNFLPRLGLALSFLAIILVFFFLLKKRSFYYPKFIKFFWRAGFLLTLIMYIEMIVELFLMK

SEQ ID NO: 5264 - protein, 81 aa, Streptococcus pneumoniae
MHIHYNTNQTTLPLEISSFLPQDHLVFTIEKVVNTLEDCHFHAFYHAFDRPSYHPKMLVSTLLFAYSQGIFSGRKIEKWKS

SEQ ID NO: 5265 - protein, 207 aa, Streptococcus pneumoniae
MEELVTLDCLFIDGTKIEANANKYSFVWKKTTEKFSAKLQEQIQVYFQEEITPLLIKYAMFDKEQKRGYKQSARNLANWHYNDKEDSYTHPDGWCYRFHHTKYQKTQTDFQQEIKVYYADEPESAPQKGLYMNERYQNLKAKECQALLSPQGRQIFAQRKIDVEPVFGQIKASLGYKRCNLRGKCQVRIDMGLVLMANNLLKYSEMK

SEQ ID NO: 5266 - protein, 2172 aa, Streptococcus pneumoniae
MIVEEKADKALETKNVVERTEQSEPSSTEAIASEKKEDEAVTPKEEKVSAKPEEKAPRIESQASSQEKPLKEDAKAVTNEEVNQMIEDRKVDFNQNWYFKLNANSKEAIKPDADVSTWKKLDLPYDWSIFNDFDHESPAQNEGGQLNGGEAWYRKTFKLDEKDLKKNVRLTFDGVYMDSQVYVNGQLVGHYPNGYNQFSYDITKYLHKDGRENVIAVHAVNKQPSSRWYSGSGIYRDVTLQVTDKVHVEKNGTTILTPKLEEQQHGKVETHVTSKIVNTDDKDHELVAEYQIVERGGHAVTGLVRTASRTLKAHESTSLDAILEVERPKLWTVLNDKPALYELITRVYRDGQLVDAKKDLFGYRYYHWTPNEGFSLNGERIKFHGVSLHHDHGALGAEENYKAEYRRLKQMKEMGVNSIRTTHNPASEQTLQIAAELGLLVQEEAFDTWYGGKKPYDYGRFFEKDATHPEARKGEKWSDFDLRTMVERGKNNPAIFMWSIGNEIGEANGDAHSLATVKRLVKVIKDVDKTRYVTMGADKFRFGNGSGGHEKIADELDAVGFNYSEDNYKALRAKHPKWLIYGSETSSATRTRGSYYRPERELKHSNGPERNYEQSDYGNDRVGWGKTATASWTFDRDNAGYAGQFIWTGTDYIGEPTPWHNQNQTPVKSSYFGIVDTAGIPKHDFYLYQSQWVSVKKKPMVHLLPHWNWENKELASKVADSEGKIPVRAYSNASSVELFLNGKSLGLKTFNKKQTSDGRTYQEGANANELYLEWKVAYQPGTLEAIARDESGKEIARDKITTAGKPAAVRLIKEDHAIAADGKDLTYIYYEIVDSHGNVVPTANNLVRFQLHGQGQLVGVDNGEQASRERYKAQADGSWIRKAFNGKGVAIVKSTEQAGKFTLTAHSDLLKSNQVTVFTGKKEGQEKTVLGTEVPKVQTIIGEAPEMPTTVPFVYSDGSRAERPVTWSSVDVSKPGIVTVKGMADGREVEARVEVIALKSELPVVKRIAPNTDLNSVDKSVSYVLTDGSVEEYEVDKWEIAEEDKAKLAIPGSRIQATGYLEGQPIHATLVVEEGNPAAPAVPTVTVGGEAVTGLTSQKPMQYRTLAYGAKLPEVTASAKNAAVTVLQASAANGMRASIFIQPKDGGPLQTYAIQFLEEAPKIAHLSLQVEKADSLKEDQTVKLSVRAHYQDGTQAVLPADKVTFSTSGEGEVAIRKGMLELHKPGAVTLNAEYEGAKGQVELTIQANTEKKIAQSIRPVNVVTDLHQEPSLPATVTVEYDKGFPKTHKVTWQAIPKEKLDSYQTFEVLGKVEGIDLEARAKVSVEGIVSVEEVSVTTPIAEAPQLPESVRTYDSNGHVSSAKVAWDAIRPEQYAKEGVFTVNGRLEGTQLTTKLHVRVSAQTEQGANISDQWTGSELPLAFASDSNPSDPVSNVNDKLISYNNQPANRWTNWNRSNPEASVGVLFGDSGILSKRSVDNLSVGFHEDHGVGAPKSYVIEYYVGKTVPTAPKNPSFVGNEDHVFNDSANWKPVTNLKAPAQLKAGEMNHFSFDKVETYAVRIRMVRADNKLGTSITEVQIFAKQVAAAKQGQTRIQVDGKDLANFNPDLTDYYLESVDGKVPAVTASVSNNGLATVVPSVREGEPVRVIAKAENGDILGEYRLHFTKDKNLLSHKPVAAVKQARLLQVGQALELPTKVPVYFTGKDGYETKDLSVEWEEVPAENLTKAGQFTVRGHVLGSDLVAEVTVRVTDKLGEALSDNPNYDENSNQAFASATNDIDKNSHDRVDYLNDGDHSENRRWTNWSPTPSSNPEVSAGVIFRENGKIVERTVAQAKLHFFADSGTDAPTKLVLERYVGPEFEVPTYYSNYQAYDADHPFNNPENWEAVPYRADKDIAAGDEINVTFKAVKAKAMRWRMERKADKSGVAMIEMTFLAPSELPQESTQSKILVDGKELADFAENRQDYQITYKGQRPKVSVEENNQVASTVVDSGEDSLPVLVRLVSESGKQVKEYRIHLTKEKPVSEKTVAAVQEDLPKLEFVEKDLAYKTVEKKDSTLYLGETRVEQEGKTGKERIFTAINPDGSKEEKLREVVEAPTDRIVLVGTKPVAQEAKKPQVSEKADTKPIDSSEASQTNKAQLPNTGSAASQAAVAAGLALLGLSAGLVVTKGKKED

SEQ ID NO: 5267 - protein, 61 aa, Streptococcus pneumoniae
LNWIFAECKLLKLGCHTMYTTWALVVANCTKYNIRRVLWGKAIGIGKEFIAFVSLLWELAQ

SEQ ID NO: 5268 - protein, 63 aa, Streptococcus pneumoniae
MKIKEQTRKLAAGCSKHSFEVVDKTDEVSSKHGFEVVDETDEVSNHIYGKATLTKFELDFRRV

SEQ ID NO: 5269 - protein, 143 aa, Streptococcus pneumoniae
LLTSSVSSTTSKPCFELTSSVLSTTSKLCFEQPAASFLVCSLIFIEFIFYRSALFCFCCVLFVTFDHLFSVPSKDTDIEYKEGYCTKDCFDITSCSVTNCPTKKFFDWSFKSRVSNQLSLAHTFWEGTYTFSKFCCKWCNKCT

SEQ ID NO: 5270 - protein, 261 aa, Streptococcus pneumoniae
LNKKIGFWGSKFFIGFILGIVIGIMGTPHPIAGVADADKWRLVIKGWLSLGLTAGVSLELFSLIGSWFIAAVEPLSQGITNVATKRLQGRKFNIGLDWPFIAGRAEIWACANVLAPIMLIEAVLLSKVGNGILPLAGIIAMGVTPALLVVTRGKLLRMIIFGTLLLPLFLLSGTLIAPFATELAKGVGAFPEGVSQTQLITHSTLEGPIEKLLGWTIGNTTTGDIKAILGAVAFLVFYIGIFAWYRKQMIKRNEEYAAKAK

SEQ ID NO: 5271 - protein, 230 aa, Streptococcus pneumoniae
MDAIFDLIGKVFNPILEMGGPVIMLIILTVLALLFGVKFSKALEGGIKLAIALTGIGAIIGMLNGAFSASLAKFVENTGIQLSITDVGWAPLATITWGSAWTLYFLLIMLIVNVVMLAMKKTDTLDVDIFDIWHLSITGLLIKWYADNNGVSQGVSLFIATAAIVLVGVLKIINSDLMKPTFDDLLNAPSSSPMTSTHMNYMMNPVIMVLDKIFEKSSQALIDMTLMLLN

SEQ ID NO: 5272 - protein, 101 aa, Streptococcus pneumoniae
MIKILAACGAGVNSSHQIKSALEEELSNRGYDVHCDAVMVKDVNEDLMKGYDIFTPIAATDLGFEPGIPVIEAGPILFRIPAMSAPVFDNIEAAIKEHGLS

SEQ ID NO: 5273 - protein, 158 aa, Streptococcus pneumoniae
MVLDYFFDKNLVFCLEADNQEQLFDQVATLLEEREIVTPTYREALITREKSFPTGLDMEFLGKDLPNVAIPHTDIVHNLAEKVVVVRLEKPVTFHNMIAPDKEVEVSLLFFIINNSSSSQTNILAQLMDFFTGNGHLEDLSKISEPEKLYAYIAEATA

SEQ ID NO: 5274 - protein, 2138 aa, Streptococcus pneumoniae
MKKSTVLSLTTAAVILAAYAPNEVVLADTSSSEDALSISDKEKVVVDKETENKEKHKDIHSAMETSQDFKEKKIAVIKEKEVVSKTPVIDTKTSNEENSNKSQGDHTDSFVNKNTENPKKEDKVVYIAEFKDKESGEKAIKELSSLKNTKVLYTYDRIFNGSAIETIPDNLDKIKQIEGISSVERAQKVQPMMNHARKEIGVEEAIDYLKSINAPFGKNFDGRGMVISNIDTGTDYRHKAMRIDDDAKASMRFKKEDLKGTDKNFWLSDKIPHAFNYYNGGKITVEKYDDGRDYFDPHGMHIAGILAGNDTEQDIKNFNGIDGIAPNAQIFSYKMYSDAGSGFAGDETMFHAIEDSIKHNVDVVSVSSGFTGTGLVGEKYWQAIRALRKAGIPMVVATGNYATSASSSSWDLVANNHLKMTDTGNVTRTAAHEDAIAVASAKNQTVEFDKVNIGGQSFKYRNIGAFFDKNKITTNEDGTKAPSKLKFVYIGKGQDQDLIGLDLRGKIAVMDRIYTKDLKNAFKKAMDKGARAIMVVNTVNYYNRDNWTELPAMGYEADEGTKSQVFSISGDDGVKLWNMINPDKKTEVKRNNKEDFKDKLEQYYPIDMESFNSNKPNVGDEKEIDFKFAPDTDKELYKEDIIVPAGSTSWGPRIDLLLKPDVSAPGKNIKSTLNVINGKSTYGYMSGTSMATPIVAASTVLIRPKLKEMLEKPVLKNLKGDDKIDLTSLTKIALQNTARPMMDATSWKEKSQYFASPRQQGAGLINVANALRNEVVATFKNTDSKGLVNSYGSISLKEIKGDKKYFTIKLHNTSNRPLTFKVSASAVTTDSLTDRLKLDETYKDEKSPDGKQIVPEIHPEKVKGANITFEHDTFTIGANSSFDLNAVINVGEAKNKNKFVESFIHFESVEEMEALSSNGKKTDFQPSLSMPLMGFAGNWNHEPILDKWAWEEGSKSKTMEGYDDDGKPKIPGTLNKGIGGEHGIDKFNPAGVIQNRKDKNRTSLDQDPDLFAFNNQGVHAESTSGSKIANIYPLDSNGNPQDAQLERGLTPSPLVLRSAEEGLISIVNTNKEGENQKDLKVVSREHFIRGILNSKGNDAKGIKSSKLKVWGDLKWDGLIYNPRGREENAPESKDNQDPATKIRGQFEPIAEGQYFYKFKYRLTKDYPWQVSYIPVKIDNTAPKIVSVDFSNPEKIKLITKDTYHKVKDQYKNETLFARDQKEHPEKFDEIANEVWYAGAALVNEDGEVEKNLEVTYAGEGQGRNRKLDKDGNTIYEISGAGDLRGKIIEVIALDGASNFTKIHRIKFANQADEKGMISYYLVDPDQDSSKYQKLGEIPESKFKNLKNVKDDSLNKETAEVENNLLVDNQSIEGKSLFNIHKTISTIRDFENKDLKKLIKKKYKQEDDFVNGGTRTVERDYKYDDKGNIIAYDDGTDLEYETEKLDEIKSKIYGVLSPSKDGHFEILGKISNVSKNAKVYYGNNYKSIEIKATKYDFHSKTMTFDLYANINDIVDGLAFAGDMRLFVKDNDQKKAEIKIRMPEKIKETKSEYPYVSSYGNVIELGEGDLSKNKPDNLTKMESGKIYSDSEKQQYLLKDNIILRKGYALKVTTYNPGKTDMLEGNGVYSKEDIAKIQKANPNLRALSETTIYADSRNVEDGRSTQAVLMSALDGFNIIRYQVFTFKMNDKGEAIDKDGNLVTDSSKLVLFGKDDKEYTGEDKSNVEAIKEDGSMLFIDTKPVNLSMDKNYFNPSKSNKIYVRNPEFYLRGKISDKGGFNWELRVNESVVDNYLIYGDLHIDNTRDFNIKLNVKDGDIMDWGMKDYKANGFPDKVTDMDGNVYLQTGYSNLNAKAVGVHYQFLYDNVKPEVNIDPKGNTSIEYADGKSVVFNINDKRNNGFDGEIQEQHIYINGKEYTSFNDIKQIIDKTLNIKIVVKDFARNTTVKEFILNKDTGEVSELKPHRVTVTIQNGKEMSSTIVSEEDFILPVYKGELEKGYQFDGWEISGFEGKKDAGYVINLSKDTFIKPVFKKIEEKKEEENKPTFDVSKKKDNPQVNHSQLNESHRKEDLQREDHSQKSDSTKDVTATVLDKNNISSKSTTNNPNKLPKTGTASGAQTLLAAGIMFIVGIFLGLKKKNQD

SEQ ID NO: 5275 - protein, 67 aa, Streptococcus pneumoniae
WYECAYNVSRLTKVLDLYSSKISSNHVNVALPCVWLLTTSVLSTTSKQCFEQSAASFLVCSLIFIEY

SEQ ID NO: 5276 - protein, 65 aa, Streptococcus pneumoniae
LLATLESEARKKVGYLQVKTVAEGSNKDYDRTNDFYRGLGFKKLEIFLQLWNPQNPCQILIKKLE

SEQ ID NO: 5277 - protein, 261 aa, Streptococcus pneumoniae
MKKYQRMHLIFIRQYIKQIMEYKVDFVVGVLGVFLAQGLNLLFLNVIFQHIPFLEGWTFQEIAFIYGFSLIPKGMDHLFFDNLWALGQRLVRKGEFDKYLTRPINPLFHILVETFQIDALGELLVGGILLGTTVTSIVWTLPKFLLFLVCIPFATLIYTSLKIATASIAFWTKQSGAMIYIFYMFNDFAKYPISIYNSLLRWLISFIVPFAFTAYYPASYFLQEKDVFFNVGGLMLISLVFFVISLKLWDKGLDSYESAGS

SEQ ID NO: 5278 - protein, 286 aa, Streptococcus pneumoniae
LRILSVASTERSSRMIKLWRRYKPFINAGVQELITYRVNFILYRIGDVMGAFVAFYLWKAVFDSSQESLIQGFSMADITLYIIMSFVTNLLTRSDSSFMIGEEVKDGSIIMRLLRPVHFAASYLFTELGSKWLIFISVGLPFLSVIVLMKIISGQGIVEVLGLTVLYLFSLTLAYLINFFFNICFGFSAFVFKNLWGSNLLKTSIVAFMSGSLIPLAFFPKVVSDILSFLPFSSLIYTPVMIIVGKYDASQILQALLLQFFWLLVMVGLSQLIWKRVQSFITIQGG

SEQ ID NO: 5279 - protein, 317 aa, Streptococcus pneumoniae
VKIVKEPGLKGALRSFIHPEKQTFEAVKDLTFEVPKGQILGFIGANGAGKSTTIKMLTGILKPTSGFCRINGKIPQDNRQDYVKDIGVVFGQRTQLWWDLALQETYTVLKEIYDVPNSLFHKRMDFLNEVLDLKDFIKDPVRTLSLGQRMRADIAASLLHNPKVLFLDEPTIGLDVSVKDNIRRAITQINQEEETTILLTTHDLSDIEQLCDRIFMIDKGQEIFDGTVSQLKETFGKMKTLSFELLPGQSHLVSHYEGLSDMTIDRQGNSLNIEFDSSRYQSADIIKQTLSDFEIRDLKMVDTDIEDIIRRFYRKEL

SEQ ID NO: 5280 - protein, 82 aa, Streptococcus pneumoniae
ITNLLIFSPEGGINFDHKIGYSLYPENMLRMIVSKQYLLFYLIHEKEVHTLRIINSRTDYLNQLDHLFRTCRKLFSSQIISL

SEQ ID NO: 5281 - protein, 131 aa, Streptococcus pneumoniae
YETIAKTFIEINFTFPIDLFSSYFNPLYIMVSNLHQNDKINQLISDYKQNMKAFYITIEKFIRDDESLKCYFTKVISSRSKVTSLDQIEADKTIQRKYSSELKKFIGFYNEIICEENSFLHVRKRWSSWFR

SEQ ID NO: 5282 - protein, 157 aa, Streptococcus pneumoniae
VRMVHTTSDLSTTSKQCFEQPEASFLVCSLVFIEYNTLLEVGLNSLISLFTFTFDILYPIVKVGHTDDYSHGAVKLSVSLVDKDVMKKISVTVIGYFEINIDENITDILYVNGTAILYPYLRSIVSIVSAIDSSEAMLLPTINVLELLDKSQPFEEE

SEQ ID NO: 5283 - protein, 229 aa, Streptococcus pneumoniae
MAKKSKQLRAALEKIDSTKAYSVEEAVALAKETNFAKFDATVEVAYNLNIDVKKADQQIRGAMVLPNGTGKTSRVLVFARGAKAEEAKAAGADFVGEDDLVAKINDGWLDFDVVIATPDMMALVGRLGRVLGPRNLMPNPKTGTVTMDVAKAVEESKGGKITYRADRAGNVQAIIGKVSFEAEKLVENFKAFNETIQKAKPATAKGTYVTNLTITTTQGVGIKVDVNSL

SEQ ID NO: 5284 - protein, 141 aa, Streptococcus pneumoniae
MAKKVEKLVKLQIPAGKATPAPPVGPALGQAGINIMGFTKEFNARTADQAGMIIPVVISVYEDKSFTFITKTPPAAVLLKKAAGVEKGSGTPNKTKVATVTRAQVQEIAETKMPDLNAANVESAMRMIEGTARSMGFTVVD

SEQ ID NO: 5285 - protein, 74 aa, Streptococcus pneumoniae
NCKRKVYFLYSMKINEQTRKLAAGYSKYSFEVANKTDEVSSKHCFEIVDRTDEVSNHTHGKATLTWFEEIFEEY

SEQ ID NO: 5286 - protein, 238 aa, Streptococcus pneumoniae
MKKRYLVLTALLALSLAACSQEKAKNEDGEAKTEQTAKADGTVGSKSQGAAQKKAEVVNKGDYYSIQGKYDEIIVANKHYPLSKDYNPGENPTAKAELVKLIKAMQEAGFPISDHYSGFRSYETQTKLYQDYVNQDGKAAADRYSARPGYSEHQTGLAFDVIGTDGDLVTEEKAAQWLLDHAADYGFVVRYLKGKEKETGYMAEEWHLRYVGKEAKEIAESGLSLEEYYGFEGGDYVD

SEQ ID NO: 5287 - protein, 60 aa, Streptococcus pneumoniae
QSCQDKVSFFHFYSFISNSLSTSDDKHSTNLLISSGFTWQVSAVISSKGTHQTGPRPLRP

SEQ ID NO: 5288 - protein, 169 aa, Streptococcus pneumoniae
LLMLILRARRYHRMCLICQRIELIKAGQNPYFVKELETGYLVIGDHQYFAGYSLFLAKEHVTELHHLKKETRLRFLEEMSLVQEAVAKAFAAEKMNIELLGNGDAHLHWHLFPRRRGDMNGHGLKGRGPVWWVPFEEMTAETCQVKPEEIKRLVECLSSEVDKLLEIKE

SEQ ID NO: 5289 - protein, 71 aa, Streptococcus pneumoniae
LAKEQDIPFKLDIYPFYGSDASAAMSAGAEVKHALLGAGIESSHSYERTHIDSVVATERIVDAYLKSEAVS

SEQ ID NO: 5290 - protein, 198 aa, Streptococcus pneumoniae
MNQTVEYIKELTAIASPTGFTREISNYLVKTLEGFGYQPVRTAKGGVNVTIKGQNDEQHRYVTAHVDTLGAIVRAVKPDGRLKLDRIGGFPWNMIEGENCTVHVASTGQKVSGTILIHQTSCHVYKDAGTAERTQDNMEVRLDVKVSNEKETRALGIEVGDFISFDPRTVVTDTGFIKSRHLDDKVSAAILLNLLRIY

SEQ ID NO: 5291 - protein, 113 aa, Streptococcus pneumoniae
LDIANLGLDAIIKYSIPVLVILYPITIAIVMIVIVNKFVALSKPGMQLPIAVVTVIAIASVQGSSFKVEFLANLVSVLPFAKASLPWLVPAIVGILLSLVLPNKQESDVFEME

SEQ ID NO: 5292 - protein, 446 aa, Streptococcus pneumoniae
MKEIFMAKKGTLTGLLLFGIFFGAGNLIFPPSLGALSGEHFLPAIAGFVFSGVGIAVLTLIIGTLNPKGYIYEISTKIAPWFATLYLSVLYLSIGPFFATPRTATTAYEVGISPLLSDANKGLGLIVFTVLYFAAAYLISLNPSKILDRIGRILTPVFAILIVILVVLGAIKYGGTSPQTASAAYQASAFGTGFLEGYNTLDALASVAFSVIAVQTLKQLGFSSKKKYISTIWVVGIVVALAFSALYIGLGFLGNHFPVPAEAMKGGTPGVYILSQATQEIFGSTAQLFLAAMVTVTCFTTTVGLIVSTAEFFNERFAQISYKVYATAFTLIGLDIANLGLDAIIKYSIPVLVILYPITIAIVMIVIVNKFVALSKPGMQLPIAVVTVIAIASVQGSSFKVEFLANLVSVLPFAKASLPWLVPAIVGILLSLVLPNKQESDVFEME

SEQ ID NO: 5293 - protein, 62 aa, Streptococcus pneumoniae
LKRFSKSIRRKRMKEIAFDAFYQLYQNDQLSLVDVREVDEFAALHLEGAHNLPLSQLADSYD

SEQ ID NO: 5294 - protein, 79 aa, Streptococcus pneumoniae
LFLLILFENLFKPRQRRLTVRMLPTSSVLSATSKLYFEQPTTSFLVCSLIFIDYKMVLILFFKSGTTSASNQGFLAIQI

SEQ ID NO: 5295 - protein, 192 aa, Streptococcus pneumoniae
MSQIERIKQAIMADSQNASYTERGIEPLFAAPKTARINIIGQAPGLKTQEAGLYWKDKSGDRLRDWLGVDEDTFYNSGYFAVLPMDFYFPGHGKSGDLPPRTGFAEKWHPQVLQELPDIQLTLLIGQYAQAYYLQEKISGKVTERVKHYKDYLPAYFPLVHPSPRNQIWMAKNPWFEAEVVPDLKKRIKTIL

SEQ ID NO: 5296 - protein, 466 aa, Streptococcus pneumoniae
MTAIDFTAEVEKRKEDLLADLFSLLEINSERDDSKADAQHPFGPGPVKALEKFLEIADRDGYPTKNVDNYAGHFEFGDGEEVLGIFAHMDVVPAGSGWDTDPYTPTIKDGRLYARGASDDKGPTTACYYGLKIIKELGLPTSKKVRFIVGTDEESGWADMDYYFEHVGLAKPDFGFSPDAEFPIINGEKGNITEYLHFAGENTGVARLHSFTGGLRENMVPESATAVVSGDLADLQAKLDAFVAEHKLRGELQEEAGKYKVTIIGKSAHGAMPASGVNGATYLALFLSQFGFAGPAKDYLDIAGKILLNDHEGENLKIAHVDEKMGALSMNAGVFHFDETSADNTIALNIRYPKGTSPEQIKSILENLPVVSVSLSEHGHTPHYVPMEDPLVQTLLNIYEKQTGFKGHEQVIGGGTFGRLLERGVAYGAMFPDSIDTMHQANEFIALDDLFRAAAIYAEAIYELIK

SEQ ID NO: 5297 - protein, 201 aa, Streptococcus pneumoniae
MKFLELNKKRHATKHFTDKPVDPKDVRTAIEIATLAPSAHNSQPWKFVVVREKNAELAKLAYGSNFEQVSSAPVTIALFTDTDLAKRARKIARVGGANNFSEEQLQYFMKNLPAEFARYSEQQVSDYLALNAGLVAMNLVLALTDQGIGSNIILGFDKSKVNEVLEIKDRFRPELLITVGYTDEKLEPSYRLPVDEIIEKR

SEQ ID NO: 5298 - protein, 79 aa, Streptococcus pneumoniae
FSQATKNGRIASNRLNFFILSPFKCKVLASLSETFLINQYISFMSVIEKLNHEKSLQALSNYGRMEAVELEKEIDYEIS

SEQ ID NO: 5299 - protein, 266 aa, Streptococcus pneumoniae
MKKFSLLLAILPFLVACENQATPKETSAQKTIVLATAGDVPPFDYEDKGNLTGFDIEVLKAVDEKLSDYEIQFQRTAWESIFPGLDSGHYQAAADNLSYTKERAEKYLYSLPISNNPLVLVSNKKNPLTSLDQIAGKTTQEDTGTSNAQFINNWNQKHTDNPATINFSGEDIGKRILDLANGEFDFLVFDKVSVQKIIKDRGLDLSVVDLPSADSPSNYIIFSSDQKEFKEQFDKALKELYQDGTLEKLSNTYLGGSYLPDQSQLQ

SEQ ID NO: 5300 - protein, 277 aa, Streptococcus pneumoniae
MNHKIAILSDVHGNATALEAVIADAKNQGASEYWLLGDIFLPGPGANDLVALLKDLPITASVRGNWDDRVLEVLDGEYGLEYPKEIQSMRMTQFLMERMDPATIVWLRSLPLLEKKEIDGLRFSISHNLPDKNYGGDLLVENDTEKFDQLLDAETDVAVYGHVHKQLLRYGSQGQQIINPGSIGMPYFNWEALKNHRAQYAVIEVEDGELVNILFRKVAYDYEAELEFAKSKRLPFIEMYEELRREDNYQRHNLELLASLIEKHRYVEDVKNFFDFL

SEQ ID NO: 5301 - protein, 614 aa, Streptococcus pneumoniae
MNNLIKSKLELLPTSPGCYIHKDKNGTIIYVGKAKNLRNRVRSYFRGSHNTKTEALVSEIVDFEFIVTESNIEALLLEINLIKENKPKYNIMLKDDKSYPFIKITNERYPRLIITRQVKKDGGLYFGPYPDVGAANEIKRLLDRIFPFRKCTNPPSKVCFYYHIGQCMAHTICKKDEAYFKSMAQEVSDFLKGQDDKIIDDLKSKMAVAAQSMEFERAAEYRDLIQAIGTLRTKQRVMAKDLQNRDVFGYYVDKGWMCVQVFFVRQGKLIERDVNLFPYFNDPDEDFLTYVGQFYQEKSHLVPNEVLIPQDIDEEAVKALVDSKILKPQRGEKKQLVNLAIKNARVSLEQKFNLLEKSVEKTQGAIENLGRLLQIPTPVRIESFDNSNIMGTSPVSAMVVFVNGKPSKKDYRKYKIKTVVGPDDYASMREVIRRRYGRVQREALTPPDLIVIDGGQGQVNIAKQVIQEELGLDIPIAGLQKNDKHQTHELLFGDPLEVVDLSRNSQEFFLLQRIQDEVHRFAITFHRQLRSKNSFSSQLDGIDGLGPKRKQNLMKHFKSLTKIKEASVDEIVEVGVPRVVAEAVQRKLNPQGEALPQVAEERVDYQTEGNHNEP

SEQ ID NO: 5302 - protein, 240 aa, Streptococcus pneumoniae
LLERWRDMRWLFRLIGAFFSFVWRLFWRLVWIVVLLCVLAFGLLWYLNGDFQGALKQAERSVKIGQQSIDQWEKTGQLPKLSQTDSHQHSEGRWPQASARIYLDPQMDSRFQEAYLEAIQNWNQTGAFNFELVTESSKADITATEMNDGGTPVAGEAESQTNLLTGQFLSVTVRLNHYYLSNPYYGYSYERLVHTAEHELGHAIGLDHTDEKSVMQPAGSFYGIQEEDVANLRKIYETSE

SEQ ID NO: 5303 - protein, 410 aa, Streptococcus pneumoniae
MALTTLTKEEFQTYSDQVSSRSFMQSVQMGDLLEKRGARIVYLALKQEGEIQVAALVYSLPMLGGLHMELNSGPIYTQQDALPVFYAELKEYAKQNGVLELLVKPYETYQTFDSQGNPIDAEKKSIIQGLTDLGYQFDGLTTGYPGGEPDWLYYKDLTELTEKSLLKSFSKKGKPLVKKAETFGIRLKKLKREELSIFKNITKETSERREYSDKSLEYYEHFYDTFGEQAEFLIASLNFSEYMSKLQGEQSKLEEKLDKLRLDLSKNPHSEKKQNQLREYSSQFETFEVRKAEARDLIEKYGEEDIVLAGSLFVYMPQETTYLFSGSYTEFNKFYAPALLQKYVMLESIKRGIPKYNFLGIQGIFDGSDGVLRFKQNFNGYIVRKAGTFRYHPSPLKYKAIQLLKKIVGR

SEQ ID NO: 5304 - protein, 406 aa, Streptococcus pneumoniae
MYRYQIGIPTLEYDQFVKEHELANVLQSSAWEEVKSNWQHEKFGVYREEKLLATASILIRTLPLGYKMFYIPRGPILDYGDKELLNFAIQSIKSYARSKRAVFVTFDPSICLSQSLINQEKTEFPENLAIIDSLQQMGVRWSGKTEEMGDTIQPRIQAKIYKENFEEDKLSKSTKQAIRTARNKGLEIQYGGLELLDSFSELMKKTEKRKEIHLRNEAYYKKLLDNFKDKAYITLATLDVSKRSQELEEQLAKNRALEETFTESTRTSKVEAQKKEKERLLEELTFLQEYIDVGQARVPLAATLSLEFGTTSVNIYAGMDDDFKRYNAPILTWYETARYAFERGMVWQNLGGVENSLNGGLYHFKEKFNPTIEEYLGEFTMPTHPLYPLLRLALDFRKTLRKKHRK

SEQ ID NO: 5305 - protein, 259 aa, Streptococcus pneumoniae
MPVMKIEYYSQVLDMEWGMNVLYPDANRVREPECEDIPVLYLLHGMSGNHNSWLKRTNVERLLRGTNLIVVMPNTSNGWYTDTQYGFDYYTALAEELPQVLKRFFPNMTSKREKTFIAGLSMGGYGCFKLALATNRFSHAASFSGALSFQNFSPESQNLGSPAYWRGVFGEIRDWTTSPYSLESLAKKSDKKTKLWAWCGEQDFLYEANNLAVKNLKKLGFDVTYSHSAGTHEWYYWEKQLEVFLTTLPIDFKLEERLT

SEQ ID NO: 5306 - protein, 553 aa, Streptococcus pneumoniae
MSNISLTTLGGVRENGKNMYIAEIGESIFVLNVGLKYPENEQLGVDVVIPNMDYLFENSDRIAGVFLTHGHADAIGALPYLLAEAKVPVFGSELTIELAKLFVKGNDAVKKFNDFHVIDENTEIDFGGTVVSFFPTTYSVPESLGIVLKTSEGSIVYTGDFKFDQTASESYATDFARLAEIGRDGVLALLSDSANADSNIQVASESEVRDEITQTIADWEGRIIVAAVSSNLSRIQQIFDAADKTGRRIVLTGFDIENIVRTAIRLKKLSLANEILLIKPKDMSRFEDHELIILETGRMGEPINGLRKMSIGRHRYVEIKDGDLVYIATAPSIAKEAFVARVENMIYQAGGVVKLITQSLHVSGHGNVRDLQLMINLLQPKYLFPVQGEYRELDAHAKAAMAVGMLPERIFIPKKGTTMAYENGDFVPAGSVSAGDILIDGNAIGDVGNVVLRDRKVLSEDGIFIVAITVNRREKKIVARARVHTRGFVYLKKSRDILRESSELINQTVEDYLQGDDFDWADLKGKVRDNLTKYLFDQTKRRPAILPVVMEAK

SEQ ID NO: 5307 - protein, 646 aa, Streptococcus pneumoniae
MTSASIVKESLEQLGAECRVYLPNRFTDGYGPNASVYKYFIEQDRISLIVTVDNGVAGHEAIALAQSMGVDVIVTDHHSMPETLPDAYAIVHPEHPDADYPFKYLAGCGVAFKLACALLEEVQVELLDLVAIGTIADMVSLTDENRILVQYGLEMLGHTQRIGLQEMLDMAGIAANEVTEETVGFQIAPRLNALGRLDDPNPAIDLLTGFDDEEAHEIALMIHQKNEERKEIVQSIYEEAKTMVDPEKKVQVLAKEGWNPGVLGIVAGRLLEELGQTVIVLNIKDGRAKGSARIVEPVDIFEALDPHRDLFIAFGGHAGAAGMTLEVEQLSDLSQVLEDYVREKGADAGGKNKLNLDEELDLEALSLETVKSFERLAPFGMDNQKPIFYIKNFQVESARTMGAGNAHLKLKISKGEASFEVVAFGQGRWATEFSQTKNLELAVKLSVNQWNGQTALQLMMVDARVEGVQLFNIRGKNAVLPEGVPVLDFPGELPNLAASEAIVVKNIPEDITQLKTIFQEQHFSAVYFKNDIDKAYYLTGYGTRDQFAKLYKTIYQFPEFDIRYKLKDLAAYLNIQQILLVKMIQVFEELGFVTIKDGVMTVNKEAPKREIGESQIYQNLKQTVKDQEMMALGTVQEIYDFLMEKE

SEQ ID NO: 5308 - protein, 740 aa, Streptococcus pneumoniae
LITPTYEWQFALQVEDADFTKIAKKAGLGPEVARLLFERGIQDQESLKKFLEPSLEDLHDAYLLHDMDKAVERIRQAIEVRENILVYGDYDADGMTSASIVKESLEQLGAECRVYLPNRFTDGYGPNASVYKYFIEQDRISLIVTVDNGVAGHEAIALAQSMGVDVIVTDHHSMPETLPDAYAIVHPEHPDADYPFKYLAGCGVAFKLACALLEEVQVELLDLVAIGTIADMVSLTDENRILVQYGLEMLGHTQRIGLQEMLDMAGIAANEVTEETVGFQIAPRLNALGRLDDPNPAIDLLTGFDDEEAHEIALMIHQKNEERKEIVQSIYEEAKTMVDPEKKVQVLAKEGWNPGVLGIVAGRLLEELGQTVIVLNIKDGRAKGSARIVEPVDIFEALDPHRDLFIAFGGHAGAAGMTLEVEQLSDLSQVLEDYVREKGADAGGKNKLNLDEELDLEALSLETVKSFERLAPFGMDNQKPIFYIKNFQVESARTMGAGNAHLKLKISKGEASFEVVAFGQGRWATEFSQTKNLELAVKLSVNQWNGQTALQLMMVDARVEGVQLFNIRGKNAVLPEGVPVLDFPGELPNLAASEAIVVKNIPEDITQLKTIFQEQHFSAVYFKNDIDKAYYLTGYGTRDQFAKLYKTIYQFPEFDIRYKLKDLAAYLNIQQILLVKMIQVFEELGFVTIKDGVMTVNKEAPKREIGESQIYQNLKQTVKDQEMMALGTVQEIYDFLMEKE

SEQ ID NO: 5309 - protein, 252 aa, Streptococcus pneumoniae
MALVEFKNVEKYYGDYHALRNINLRFEKGQVVVLLGPSGSGKSTLIRTINGLETVDKGSLLVNGHQVAGASQKDLVPLRKEVGMVFQHFNIYPHKTVLENVTLAPIKVLGIDKKEAEKTAQKYLEFVNVWDKKDSYPAMLSGGQKQRIAIARGLAMHPELLLFDEPTSALDPETIGDVLAVMQKLAHDGMNMIIVTHEMGFAREVADRIIFMADGEVLVDTTDVDNFFDNPSKPRAQQFLSKIINHESDKVK

SEQ ID NO: 5310 - protein, 64 aa, Streptococcus pneumoniae
LRRGTKSFWLAPATWCPLTRRLPLSTVSKPLIVRIRVDFPEPEGPSRTTTCPFSKRRLMLRSAW

SEQ ID NO: 5311 - protein, 73 aa, Streptococcus pneumoniae
MRSATSRAKPISWVTMIMFIPSCASFCITARTSPIVSGSRADVGSSKRRSSGCIARPRAMAIRCFCPPDSMAG

SEQ ID NO: 5312 - protein, 264 aa, Streptococcus pneumoniae
MKKKFFLSALLISLFGLAAAKPVQADTSIADIQKRGELVVGVKQDVPNFGYKDPKTGTYSGIETDLAKMVADELKVKIRYVPVTAQTRGPLLDNEQVDMDIATFTITDERKKLYNFTSPYYTDASGFLVNKSAKIKKIEDLNGKTIGVAQGSITQRLITELGKKKGLKFKFVELGSYPELITSLHAHRIDAFSVDHSILSGYTSKRTALLDDSFKPSDYSIVTKKSNTELNDYLDNLVTKWSKDGSLQKLYDRYKLKPSSHTAD

SEQ ID NO: 5313 - protein, 225 aa, Streptococcus pneumoniae
MTDLSSWTAYFQDFGQFFNGFLFTLALAIGSFILAMVLGIFFGAMSTSKRPILRILARIFVEFYQNTPLLVQFVIVFYGLPLISDHIIMIPIYWTAVLCVGLYHGAYIAEVIRSGIQSIPSGQMEAALSQGFTYISAMRLIILPQAFRIILPPLTNQIVNLIKNTSTVAIISGVDLMFVTKSWSALNGNYIPAFLGAALLYFALCFPVAQFGRKMEQANKKAYSL

SEQ ID NO: 5314 - protein, 219 aa, Streptococcus pneumoniae
MESILEILTPDNLVFIFKGFGLTLYISLIAIILSTIIGTVLAVMRNGKNPILRIISSIYIEFVRNVPNLLWIFTIFLVFKMKSTPAGITAFTLFTSAALAEIIRGGLNAVDKGQYEAGMSQGFTSAQILYYIILPQAIRKMLPAIISQFVTVIKDTSLLYSVIALQELFGASQILMGRYFEPEQVFSLYILIALIYFSFNLAISNLSHMLAKRWQQAAE

SEQ ID NO: 5315 - protein, 400 aa, Streptococcus pneumoniae
MEFSMKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKRVHFYYSFRGEENAVYLDLLRDYAQKNPNFELHLIDSTKDGYLNFEQKEVPEHATVYMCGPISMMKALAKQIKKQNPKTELIYEGFKFK

SEQ ID NO: 5316 - protein, 293 aa, Streptococcus pneumoniae
MAIVSAEKFVQAARDNGYAVGGFNTNNLEWTQAILRAAEAKKAPVLIQTSMGAAKYMGGYKVARNLIANLVESMGITVPVAIHLDHGHYEDALECIEVGYTSIMFDGSHLPVEENLKLAKEVVEKAHAKGISVEAEVGTIGGEEDGIIGKGELAPIEDAKAMVETGIDFLAAGIGNIHGPYPVNWEGLDLDHLQKLTEALPGFPIVLHGGSGIPDEQIQAAIKLGVAKVNVNTECQIAFANATRKFARDYEANEAEYDKKKLFDPRKFLADGVKAIQASVEERIDVFGSEGKA

SEQ ID NO: 5317 - protein, 442 aa, Streptococcus pneumoniae
MKRTGLFAKIFIYTFSIFSVLVICLHLAIYFLFPSTYLSHRQETIGQKATAIAQSLEGKDRQSIEQVLDLYSQTSDIKGTVKGEMTEDKLEVKDSLPLDTDRQTTSLFIEEREVKTQDGGTMILQFLASMDLQKEAEQISLQFLPYTLLASFLISLLVAYIYARTIVAPILEIKRVTRRMMDLDSQVRLRVDSKDEIGNLKEQINSLYQHLLTVIADLHEKNEAILQLEKMKVEFLRGASHELKTPLASLKILIENMRENIGRYKDRDQYLGVALGIVDELNHHVLQILSLSSVQELRDDRETIDLLQMTQNLVKDYALLAKERELQIDNSLTHQQAYLNPSVMKLILSNLISNAIKHSVPGGLVRIGEREGELFIENSCSSEEQEKLAQSFSDNASRKVKGSGMGLFVVKSLLEHEKLAYRFEMEENRLTFFIDFPKVAQD

SEQ ID NO: 5318 - protein, 218 aa, Streptococcus pneumoniae
MKILIVEDEEMIREGVSDYLTDCGYETIEAADGQEALEQFSSYEVALVLLDIQMPKLNGLEVLAEIRKTSQVPVLMLTAFQDEEYKMSAFASLADGYLEKPFSLSLLKVRVDAIFKRYYDTGRIFSYKDTKVDFESYSASLAGQEVPINAKELEILDYLVKNEGRALTRSQIIDAVWKATDEVPFDRVIDVYIKELRKKLDLDCILTVRNVGYKLERK

SEQ ID NO: 5319 - protein, 459 aa, Streptococcus pneumoniae
MLHNAFAYVTRKFFKSIVIFLIILLMASLSLVGLSIKGATAKASQETFKNITNSFSMQINRRVNQGTPRGAGNIKGEDIKKITENKAIESYVKRINAIGDLTGYDLIETPETKKNLTADRAKRFGSSLMITGVNDSSKEDKFVSGSYKLVEGEHLTNDDKDKILLHKDLAAKHGWKVGDKVKLDSNIYDADNEKGAKETVEVTIKGLFDGHNKSAVTYSQELYENTAITDIHTAAKLYGYTEDTAIYGDATFFVTADKNLDDVMKELNGISGINWKSYTLVKSSSNYPALEQSISGMYKMANLLFWGSLSFSVLLLALLLSLWINARRKEVGILLSIGLKQASILGQFITESILIAIPALVSAYFLANYTARAIGNTVLANVTSGVAKQASKAAQASNLGGGAEVDGFSKTLSSLDISIQTSDFIIIFVLALVLVVLVMALASSNLLRKQPKELLLDGE

SEQ ID NO: 5320 - protein, 215 aa, Streptococcus pneumoniae
MTLLQLQDVTYRYKNTAEAVLYQIDYNFEPGKFYSIIGESGAGKSTLLSLLAGLDSPVEGSILFQGEDIRKKGYSYHRMHHISLVFQNYNLIDYLSPLENIRLVNKKASKNTLLELGLDESQIKRNVLQLSGGQQQRVAIARSLVSEAPVILADEPTGNLDPKTAGDIVELLKSLAQKTGKCVIVVTHSKEVAQASDITLELKDKKLTETRNTSK

SEQ ID NO: 5321 - protein, 425 aa, Streptococcus pneumoniae
MNPIQRSWAYVSRKRLRSFILFLILLVLLAGISACLTLMKSNKTVESNLYKSLNTSFSIKKIENGQTFKLSDLASVSKIKGLENVSPELETVAKLKDKEAVTGEQSVERDDLSAADNNLVSLTALEDSSKDVTFTSSAFNLKEGRHLQKGDSKKILIHEELAKKNGLSLHDKIGLDAGQSESGKGQTVEFEIIGIFSGKKQEKFTGLSSDFSENQVFTDYESSQTLLGNSEAQVSAARFYVENPKEMDGLMKQVENLALENQGYQVEKENKAFEQIKDSVATFQTFLTIFLYGMLIAGAGALILVLSLWLRERVYEVGILLALGKGKSSIFLQFCLEVVLVSLGALLPAFVAGNGITTYLLQTLLASGDQASLQDTLAKASSLSTSILSFAESYVFLVLLSCLSVALCFLFLFRKSPKEILSSIS

SEQ ID NO: 5322 - protein, 84 aa, Streptococcus pneumoniae
EGLEIIPYSIFFFFVFHKHFIFGFYNSLTNMEVTNESNPKILGLCQQKATEKFYFISDFIGLIGRNFSLFDSDEVQQNSRKQSL

SEQ ID NO: 5323 - DNA, 15 bp, Streptococcus pneumoniae
gtcttcaccacgggg

SEQ ID NO: 5324 - DNA, 11 bp, Streptococcus pneumoniae
gtggtgaagac

SEQ ID NO: 5325 - DNA, 2493 bp, Streptococcus pneumoniae
agtgaggaaagaatgaaaatcaataaaaaatatctagcaggttcagtggcagtccttgccctaagtgtttgttcctatgaacttggtcgtcaccaagctggtcaggttaagaaagagtctaatcgagtttcttatatagatggtgatcaggctggtcaaaaggcagaaaatttgacaccagatgaagtcagtaagagagaggggatcaacgccgaacaaattgttatcaagattacggatcaaggttatgtgacctctcatggagaccattatcattactataatggcaaggttccttatgatgccatcatcagtgaagaacttctcatgaaagatccgaattatcagttgaaggattcagacattgtcaatgaaatcaagggtggctatgtgattaaggtagacggaaaatactatgtttaccttaaagatgcggcccatgcggacaatattcggacaaaagaagagattaaacgtcagaagcaggaacacagtcataatcataactcaagagcagataatgctgttgctgcagccagagcccaaggacgttatacaacggatgatgggtatatcttcaatgcatctgatatcattgaggacacgggtgatgcttatatcgttcctcacggcgaccattaccattacattcctaagaatgagttatcagctagcgagttagctgctgcagaagcctattggaatgggaagcagggatctcgtccttcttcaagttctagttataatgcaaatccagttcaaccaagattgtcagagaaccacaatctgactgtcactccaacttatcatcaaaatcaaggggaaaacatttcaagccttttacgtgaattgtatgctaaacccttatcagaacgccatgtagaatctgatggccttattttcgacccagcgcaaatcacaagtcgaaccgccagaggtgtagctgtccctcatggtaaccattaccactttatcccttatgaacaaatgtctgaattggaaaaacgaattgctcgtattattccccttcgttatcgttcaaaccattgggtaccagattcaagaccagaacaaccaagtccacaatcgactccggaacctagtccaagtctgcaacctgcaccaaatcctcaaccagctccaagcaatccaattgatgagaaattggtcaaagaagctgttcgaaaagtaggcgatggttatgtctttgaggagaatggagtttctcgttatatcccagccaaggatctttcagcagaaacagcagcaggcattgatagcaaactggccaagcaggaaagtttatctcataagctaggagctaagaaaactgacctcccatctagtgatcgagaattttacaataaggcttatgacttactagcaagaattcaccaagatttacttgataataaaggtcgacaagttgattttgaggttttggataacctgttggaacgactcaaggatgtctcaagtgataaagtcaagttagtggatgatattcttgccttcttagctccgattcgtcatccagaacgtttaggaaaaccaaatgcgcaaattacctacactgatgatgagattcaagtagccaagttggcaggcaagtacacaacagaagacggttatatctttgatcctcgtgatataaccagtgatgagggggatgcctatgtaactccacatatgacccatagccactggattaaaaaagatagtttgtctgaagctgagagagcggcagcccaggcttatgctaaagagaaaggtttgacccctccttcgacagaccatcaggattcaggaaatactgaggcaaaaggagcagaagctatctacaaccgcgtgaaagcagctaagaaggtgccacttgatcgtatgccttacaatcttcaatatactgtagaagtcaaaaacggtagtttaatcatacctcattatgaccattaccataacatcaaatttgagtggtttgacgaaggcctttatgaggcacctaaggggtatactcttgaggatcttttggcgactgtcaagtactatgtcgaacatccaaacgaacgtccgcattcagataatggttttggtaacgctagcgaccatgttcaaagaaacaaaaatggtcaagctgataccaatcaaacggaaaaaccaagcgaggagaaacctcagacagaaaaacctgaggaagaaacccctcgagaagagaaaccacaaagcgagaaaccagagtctccaaaaccaacagaggaaccagaagaagaatcaccagaggaatcagaagaacctcaggtcgagactgaaaaggttgaagaaaaactgagagaggctgaagatttacttggaaaaatccaggatccaattatcaagtccaatgccaaagagactctcacaggattaaaaaataatttactatttggcacccaggacaacaatactattatggcagaagctgaaaaactattggctttattaaaggagagtaagtaa

SEQ ID NO: 5326 - protein, 830 aa, Streptococcus pneumoniae
SEERMKINKKYLAGSVAVLALSVCSYELGRHQAGQVKKESNRVSYIDGDQAGQKAENLTPDEVSKREGINAEQIVIKITDQGYVTSHGDHYHYYNGKVPYDAIISEELLMKDPNYQLKDSDIVNEIKGGYVIKVDGKYYVYLKDAAHADNIRTKEEIKRQKQEHSHNHNSRADNAVAAARAQGRYTTDDGYIFNASDIIEDTGDAYIVPHGDHYHYIPKNELSASELAAAEAYWNGKQGSRPSSSSSYNANPVQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEQPSPQSTPEPSPSLQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEVLDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESK
